United States Patent
Jooss et al.

(10) Patent No.: US 12,098,383 B2
(45) Date of Patent: *Sep. 24, 2024

(54) MODIFIED ADENOVIRUSES

(71) Applicant: Gritstone bio, Inc., Emeryville, CA (US)

(72) Inventors: Karin Jooss, San Diego, CA (US); Ciaran Daniel Scallan, San Francisco, CA (US); Leonid Gitlin, Foster City, CA (US)

(73) Assignee: Gritstone bio, Inc., Emeryville, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/150,141

(22) Filed: Jan. 4, 2023

(65) Prior Publication Data

US 2023/0407332 A1 Dec. 21, 2023

Related U.S. Application Data

(63) Continuation of application No. 17/538,716, filed on Nov. 30, 2021, now Pat. No. 11,591,619, which is a continuation of application No. PCT/US2020/035591, filed on Jun. 1, 2020.

(60) Provisional application No. 62/854,865, filed on May 30, 2019.

(51) Int. Cl.
| | |
|---|---|
| *C12N 15/86* | (2006.01) |
| *A61K 38/00* | (2006.01) |
| *A61K 39/00* | (2006.01) |
| *A61K 39/395* | (2006.01) |
| *A61P 35/00* | (2006.01) |
| *A61P 37/04* | (2006.01) |
| *C07K 14/74* | (2006.01) |

(52) U.S. Cl.
CPC ...... *C12N 15/86* (2013.01); *A61K 39/001114* (2018.08); *A61K 39/3955* (2013.01); *A61P 35/00* (2018.01); *A61P 37/04* (2018.01); *C07K 14/70539* (2013.01); *A61K 38/00* (2013.01); *C12N 2710/10343* (2013.01); *C12N 2710/10352* (2013.01); *C12N 2710/10371* (2013.01); *C12N 2830/006* (2013.01); *C12N 2830/50* (2013.01); *C12N 2840/203* (2013.01)

(58) Field of Classification Search
CPC ......... C12N 15/86; C12N 2710/10343; C12N 2710/10352; C12N 2710/10371; C12N 2830/006; C12N 2830/50; C12N 2840/203; C12N 2710/10334; C12N 2830/003; A61K 39/001114; A61K 39/3955; A61K 38/00; A61K 39/00; A61K 39/0011; A61K 2039/5256; A61K 39/001189; A61P 35/00; A61P 37/04; A61P 37/00; C07K 14/70539; C07K 14/005

See application file for complete search history.

(56) References Cited

U.S. PATENT DOCUMENTS

| | | |
|---|---|---|
| 4,235,871 A | 11/1980 | Papahadjopoulos et al. |
| 4,501,728 A | 2/1985 | Geho et al. |
| 4,656,127 A | 4/1987 | Mundy |
| 4,722,848 A | 2/1988 | Paoletti et al. |
| 4,837,028 A | 6/1989 | Allen |
| 5,019,369 A | 5/1991 | Present et al. |
| 5,204,253 A | 4/1993 | Sanford et al. |
| 5,217,879 A | 6/1993 | Huang et al. |
| 5,279,833 A | 1/1994 | Rose |
| 5,505,947 A | 4/1996 | Johnston et al. |
| 5,580,859 A | 12/1996 | Felgner et al. |
| 5,589,466 A | 12/1996 | Felgner et al. |
| 5,622,931 A | 4/1997 | Edgington et al. |
| 5,643,576 A | 7/1997 | Johnston et al. |
| 5,662,907 A | 9/1997 | Kubo et al. |
| 5,814,482 A | 9/1998 | Dubensky, Jr. et al. |
| 5,843,723 A | 12/1998 | Dubensky, Jr. et al. |
| 5,849,561 A | 12/1998 | Falck-Pedersen |
| 5,849,589 A | 12/1998 | Tedder et al. |
| 5,851,796 A | 12/1998 | Schatz |
| 5,994,132 A * | 11/1999 | Chamberlain ..... C07K 14/4708 435/320.1 |
| 6,015,686 A | 1/2000 | Dubensky, Jr. et al. |
| 6,037,135 A | 3/2000 | Kubo et al. |
| 6,083,716 A | 7/2000 | Wilson et al. |
| 6,090,406 A | 7/2000 | Popescu et al. |
| 6,296,854 B1 | 10/2001 | Pushko et al. |
| 6,312,946 B1 | 11/2001 | Yeh et al. |
| 6,365,394 B1 | 4/2002 | Gao et al. |

(Continued)

FOREIGN PATENT DOCUMENTS

| | | |
|---|---|---|
| CA | 2705787 A1 | 6/2009 |
| CN | 1388247 A | 1/2003 |

(Continued)

OTHER PUBLICATIONS

Olsen PA, Krauss S. The Adenoviral E1B-55k Protein Present in HEK293 Cells Mediates Abnormal Accumulation of Key WNT Signaling Proteins in Large Cytoplasmic Aggregates. Genes (Basel). Nov. 29, 2021;12(12):1920. (Year: 2021).*

(Continued)

*Primary Examiner* — Rachel B Gill
(74) *Attorney, Agent, or Firm* — Goodwin Procter LLP

(57) ABSTRACT

Compositions include modified adenoviruses. Nucleotides, cells, and methods associated with the compositions, including their use as vaccines. Viral vectors using a TET promoter system and methods of producing viruses having the same.

35 Claims, 65 Drawing Sheets

Specification includes a Sequence Listing.

(56) References Cited

U.S. PATENT DOCUMENTS

| | | |
|---|---|---|
| 6,376,236 B1 | 4/2002 | Dubensky, Jr. et al. |
| 6,413,935 B1 | 7/2002 | Sette et al. |
| 6,475,480 B1 | 11/2002 | Mehtali et al. |
| 6,531,135 B1 | 3/2003 | Johnston et al. |
| 6,610,321 B2 | 8/2003 | Huang et al. |
| 6,770,283 B1 | 8/2004 | Garoff et al. |
| 6,783,939 B2 | 8/2004 | Olmsted et al. |
| 7,078,218 B2 | 7/2006 | Smith et al. |
| 7,202,351 B1 | 4/2007 | Sette et al. |
| 7,283,337 B2 | 10/2007 | Sakai et al. |
| 7,285,265 B2 | 10/2007 | Vogels et al. |
| 7,291,498 B2 | 11/2007 | Roy et al. |
| 7,344,872 B2 | 3/2008 | Gao et al. |
| 7,468,181 B2 | 12/2008 | Vogels et al. |
| 7,507,803 B2 | 3/2009 | Sette et al. |
| 7,531,180 B2 | 5/2009 | Polo et al. |
| 7,541,038 B2 | 6/2009 | Kovacs et al. |
| 7,557,200 B2 | 7/2009 | Wu et al. |
| 7,572,453 B2 | 8/2009 | Polo et al. |
| 7,572,628 B2 | 8/2009 | Dubensky, Jr. et al. |
| 7,605,235 B2 | 10/2009 | Anderson et al. |
| 7,732,129 B1 | 6/2010 | Zhang et al. |
| 7,744,900 B2 | 6/2010 | Dubensky, Jr. et al. |
| 7,771,979 B2 | 8/2010 | Polo et al. |
| 7,820,440 B2 | 10/2010 | Vogels et al. |
| 7,820,441 B2 | 10/2010 | Chamberlain et al. |
| 7,838,277 B2 | 11/2010 | Gao et al. |
| 7,850,977 B2 | 12/2010 | Kamrud et al. |
| 7,888,472 B2 | 2/2011 | Sette et al. |
| 8,052,967 B2 | 11/2011 | Vogels et al. |
| 8,093,021 B2 | 1/2012 | Hurtado et al. |
| 8,119,336 B2 | 2/2012 | Sampath et al. |
| 8,158,418 B2 | 4/2012 | Polo et al. |
| 8,216,834 B2 | 7/2012 | Colloca et al. |
| 8,252,574 B2 | 8/2012 | Mason et al. |
| 8,426,188 B2 | 4/2013 | Weaver et al. |
| 8,460,913 B2 | 6/2013 | Kamrud et al. |
| 8,614,082 B2 | 12/2013 | Frolov et al. |
| 8,617,533 B2 | 12/2013 | Smith et al. |
| 8,637,313 B2 | 1/2014 | Chamberlain et al. |
| 8,647,864 B2 | 2/2014 | Polo et al. |
| 8,673,319 B2 | 3/2014 | Colloca et al. |
| 8,680,258 B2 | 3/2014 | Coffield et al. |
| 8,691,563 B2 | 4/2014 | Pushko et al. |
| 8,722,044 B2 | 5/2014 | Almagro et al. |
| 8,951,525 B2 | 2/2015 | Almagro et al. |
| 8,961,995 B2 | 2/2015 | Frolov et al. |
| 8,999,333 B2 | 4/2015 | Almagro et al. |
| 9,017,696 B2 | 4/2015 | Draper et al. |
| 9,024,001 B2 | 5/2015 | Tang et al. |
| 9,101,572 B2 | 8/2015 | Pushko et al. |
| 9,115,402 B2 | 8/2015 | Hacohen |
| 9,192,661 B2 | 11/2015 | Jain et al. |
| 9,217,159 B2 | 12/2015 | Roy et al. |
| 9,234,181 B2 | 1/2016 | Tang et al. |
| 9,249,191 B2 | 2/2016 | Ueno et al. |
| 9,254,265 B2 | 2/2016 | Geall et al. |
| 9,255,126 B2 | 2/2016 | Polo et al. |
| 9,273,288 B2 | 3/2016 | Mason et al. |
| 9,295,646 B2 | 3/2016 | Brito et al. |
| 9,340,830 B2 | 5/2016 | Lipson et al. |
| 9,353,353 B2 | 5/2016 | Nabel et al. |
| 9,402,888 B2 | 8/2016 | Ertl et al. |
| 9,416,370 B2 | 8/2016 | Smith et al. |
| 9,453,240 B2 | 9/2016 | Chamberlain et al. |
| 9,486,519 B2 | 11/2016 | Sahin et al. |
| 9,487,563 B2 | 11/2016 | Nabel et al. |
| 9,512,190 B2 | 12/2016 | Ueno et al. |
| 9,580,690 B2 | 2/2017 | Weaver et al. |
| 9,714,435 B2 | 7/2017 | Dicks et al. |
| 9,770,463 B2 | 9/2017 | Geall et al. |
| 9,795,668 B2 | 10/2017 | Jain et al. |
| 9,801,897 B2 | 10/2017 | Geall et al. |
| 9,943,579 B2 | 4/2018 | Weinschenk et al. |
| 10,092,636 B2 | 10/2018 | Binder |
| 10,106,781 B2 | 10/2018 | Barouch et al. |
| 10,238,733 B2 | 3/2019 | Brito et al. |
| 10,240,128 B2 | 3/2019 | Thirion et al. |
| 10,487,332 B2 | 11/2019 | Geall |
| 10,532,067 B2 | 1/2020 | Geall et al. |
| 2002/0065241 A1 | 5/2002 | Shankara |
| 2002/0119127 A1 | 8/2002 | Sette et al. |
| 2002/0137081 A1 | 9/2002 | Bandman |
| 2003/0044774 A1 | 3/2003 | Valenzuela et al. |
| 2003/0072767 A1 | 4/2003 | Gaiger et al. |
| 2003/0148262 A1 | 8/2003 | Polo et al. |
| 2003/0232324 A1 | 12/2003 | Polo et al. |
| 2004/0037843 A1 | 2/2004 | Fikes et al. |
| 2004/0115625 A1 | 6/2004 | Ebner |
| 2004/0248113 A1 | 12/2004 | Sette et al. |
| 2005/0003505 A1 | 1/2005 | Marasco et al. |
| 2005/0123555 A1 | 6/2005 | Olmsted et al. |
| 2005/0196754 A1 | 9/2005 | Drmanac et al. |
| 2005/0271676 A1 | 12/2005 | Sette et al. |
| 2006/0051405 A1 | 3/2006 | MacLachlan et al. |
| 2006/0093623 A1 | 5/2006 | Andrieu et al. |
| 2006/0198854 A1 | 9/2006 | Pushko |
| 2006/0252077 A1 | 11/2006 | Buzby |
| 2006/0292175 A1 | 12/2006 | Polo et al. |
| 2007/0031442 A1 | 2/2007 | Sewell |
| 2007/0055049 A1 | 3/2007 | Grey et al. |
| 2007/0224201 A1 | 9/2007 | Wu et al. |
| 2007/0231347 A1 | 10/2007 | Wilson et al. |
| 2008/0050393 A1 | 2/2008 | Tang et al. |
| 2008/0206837 A1 | 8/2008 | Vogels et al. |
| 2008/0241189 A1 | 10/2008 | Wilson |
| 2009/0075384 A1 | 3/2009 | Kamrud et al. |
| 2009/0081200 A1 | 3/2009 | Wang |
| 2009/0093050 A1 | 4/2009 | Wu et al. |
| 2009/0118181 A1 | 5/2009 | Walker et al. |
| 2009/0253184 A1 | 10/2009 | Clarke et al. |
| 2009/0305344 A1 | 12/2009 | Polo et al. |
| 2010/0041737 A1 | 2/2010 | Naldini et al. |
| 2010/0068218 A1 | 3/2010 | Sette et al. |
| 2010/0120897 A1 | 5/2010 | Hurtado et al. |
| 2010/0183665 A1 | 7/2010 | Kamrud et al. |
| 2010/0286070 A1 | 11/2010 | Verheyden et al. |
| 2010/0330121 A1 | 12/2010 | Dubensky, Jr. et al. |
| 2011/0052634 A1 | 3/2011 | Weaver et al. |
| 2011/0091496 A1 | 4/2011 | Graham et al. |
| 2011/0129498 A1 | 6/2011 | Cortese et al. |
| 2011/0142880 A1 | 6/2011 | Lemiale et al. |
| 2011/0217332 A1 | 9/2011 | Colloca et al. |
| 2011/0293637 A1 | 12/2011 | Hacohen et al. |
| 2012/0027788 A1 | 2/2012 | Colloca et al. |
| 2012/0258126 A1 | 10/2012 | Scholler et al. |
| 2012/0282290 A1 | 11/2012 | Spencer et al. |
| 2012/0328651 A1 | 12/2012 | Colloca et al. |
| 2013/0011426 A1 | 1/2013 | Tureci et al. |
| 2013/0123199 A1 | 5/2013 | Lee |
| 2013/0149375 A1 | 6/2013 | Geall |
| 2013/0171241 A1 | 7/2013 | Geall |
| 2013/0177639 A1 | 7/2013 | Geall et al. |
| 2013/0177640 A1 | 7/2013 | Geall et al. |
| 2013/0189351 A1 | 7/2013 | Geall |
| 2013/0195968 A1 | 8/2013 | Geall et al. |
| 2013/0195969 A1 | 8/2013 | Geall et al. |
| 2013/0202684 A1 | 8/2013 | Geall et al. |
| 2014/0010841 A1 | 1/2014 | Weaver et al. |
| 2014/0141070 A1 | 5/2014 | Geall et al. |
| 2014/0178438 A1 | 6/2014 | Sahin et al. |
| 2014/0227346 A1 | 8/2014 | Geall et al. |
| 2014/0234304 A1 | 8/2014 | Almagro et al. |
| 2014/0242152 A1 | 8/2014 | Geall et al. |
| 2014/0248314 A1 | 9/2014 | Swanson et al. |
| 2014/0255472 A1 | 9/2014 | Geall et al. |
| 2014/0271724 A1 | 9/2014 | Ertl et al. |
| 2014/0271829 A1 | 9/2014 | Lilja et al. |
| 2015/0001108 A1 | 1/2015 | Lee et al. |
| 2015/0110831 A1 | 4/2015 | Gilbert et al. |
| 2015/0125465 A1 | 5/2015 | Binder et al. |
| 2015/0125477 A1 | 5/2015 | Kuttruff-Coqui et al. |
| 2015/0140068 A1 | 5/2015 | Barnett et al. |
| 2015/0167003 A1 | 6/2015 | Naldini et al. |

(56) References Cited

U.S. PATENT DOCUMENTS

| | | |
|---|---|---|
| 2015/0307897 A1 | 10/2015 | Soden et al. |
| 2015/0337270 A1 | 11/2015 | Lee et al. |
| 2016/0008447 A1 | 1/2016 | Hacohen et al. |
| 2016/0074506 A1 | 3/2016 | Jain et al. |
| 2016/0101170 A1 | 4/2016 | Hacohen et al. |
| 2016/0199513 A1 | 7/2016 | Bancel et al. |
| 2016/0289674 A1 | 10/2016 | Bancel et al. |
| 2016/0331822 A1 | 11/2016 | Hacohen et al. |
| 2016/0339090 A1 | 11/2016 | Hacohen et al. |
| 2016/0354409 A1 | 12/2016 | Wang et al. |
| 2017/0028044 A1 | 2/2017 | Soon-Shiong et al. |
| 2017/0212984 A1 | 7/2017 | Yelensky et al. |
| 2017/0340721 A1 | 11/2017 | Volkmann et al. |
| 2018/0000913 A1 | 1/2018 | Hacohen et al. |
| 2018/0050059 A1 | 2/2018 | Geall et al. |
| 2018/0055922 A1 | 3/2018 | Hacohen et al. |
| 2018/0153975 A1 | 6/2018 | Fritsch et al. |
| 2018/0363066 A1 | 12/2018 | Chalmers et al. |
| 2019/0025308 A1 | 1/2019 | Cummings et al. |
| 2019/0060432 A1 | 2/2019 | Hacohen et al. |
| 2019/0134184 A1 | 5/2019 | Yu et al. |
| 2019/0256924 A1 | 8/2019 | Vogelstein et al. |
| 2019/0270766 A1 | 9/2019 | Hogrefe et al. |
| 2020/0010849 A1 | 1/2020 | Blair et al. |
| 2020/0197500 A1 | 6/2020 | Blair et al. |
| 2021/0213122 A1 | 7/2021 | Blair et al. |
| 2022/0125919 A1 | 4/2022 | Jooss et al. |
| 2022/0226453 A1 | 7/2022 | Blair et al. |
| 2022/0265797 A1 | 8/2022 | Jooss et al. |

FOREIGN PATENT DOCUMENTS

| | | |
|---|---|---|
| CN | 101579528 A | 11/2009 |
| CN | 102170900 A | 8/2011 |
| EP | 1585812 A2 | 10/2005 |
| EP | 2044947 A1 | 4/2009 |
| EP | 2370584 A1 | 10/2011 |
| EP | 2590670 B1 | 5/2013 |
| EP | 2590676 B1 | 5/2013 |
| EP | 2917353 A1 | 9/2015 |
| EP | 2947149 A1 | 11/2015 |
| FR | 2650840 A1 | 2/1991 |
| JP | 2000-106875 A | 4/2000 |
| JP | 2002-199894 A | 7/2002 |
| JP | 2007-534295 A | 11/2007 |
| JP | 2011-504724 A | 2/2011 |
| JP | 2012-516679 A | 7/2012 |
| JP | 2013-537426 A | 10/2013 |
| JP | 2014-209917 A | 11/2014 |
| JP | 2015-536147 A | 12/2015 |
| KR | 20060017635 A | 2/2006 |
| RU | 2206329 C2 | 6/2003 |
| WO | 1991/02087 A1 | 2/1991 |
| WO | 1991/06309 A1 | 5/1991 |
| WO | 1992/15712 A1 | 9/1992 |
| WO | 1993/24640 A2 | 12/1993 |
| WO | 1995/007994 A2 | 3/1995 |
| WO | 1995/13392 A1 | 5/1995 |
| WO | 1996/13597 A2 | 5/1996 |
| WO | 1996/18373 A1 | 6/1996 |
| WO | 1997/021826 | 12/1996 |
| WO | 1997/41241 A1 | 11/1997 |
| WO | 2000/018433 A2 | 4/2000 |
| WO | 2001047541 A1 | 7/2001 |
| WO | 2001/055177 A2 | 8/2001 |
| WO | 2001/073027 A2 | 10/2001 |
| WO | 2004023973 A2 | 3/2004 |
| WO | 2004/055166 A2 | 7/2004 |
| WO | 2005/016961 A1 | 2/2005 |
| WO | 2005/033265 A2 | 4/2005 |
| WO | 2005/071093 A2 | 8/2005 |
| WO | 2006/078294 A2 | 7/2006 |
| WO | 2006/090090 A2 | 8/2006 |
| WO | 2007/024708 A2 | 3/2007 |
| WO | 2007/047749 A1 | 4/2007 |
| WO | 2008/122811 A2 | 10/2008 |
| WO | 2008/145685 A1 | 12/2008 |
| WO | 2009/079185 A2 | 6/2009 |
| WO | 2010/086189 A2 | 8/2010 |
| WO | 2011/128704 A1 | 10/2011 |
| WO | 2011/143656 A2 | 11/2011 |
| WO | 2012/006359 A1 | 1/2012 |
| WO | 2012/006377 A2 | 1/2012 |
| WO | 2012/024350 A2 | 2/2012 |
| WO | 2012/006376 A3 | 4/2012 |
| WO | 2012/172058 A1 | 12/2012 |
| WO | 2012/172277 A1 | 12/2012 |
| WO | 2014/072929 A1 | 5/2014 |
| WO | 2014/078688 A2 | 5/2014 |
| WO | 2014/168874 A2 | 10/2014 |
| WO | 2015/085233 A1 | 6/2015 |
| WO | 2015/095811 A2 | 6/2015 |
| WO | 2016/085904 A1 | 6/2016 |
| WO | 2016/100975 A1 | 6/2016 |
| WO | 2016/100977 A1 | 6/2016 |
| WO | 2016/122414 A1 | 8/2016 |
| WO | 2016/124670 A1 | 8/2016 |
| WO | 2016/154047 A2 | 9/2016 |
| WO | 2016/154246 A1 | 9/2016 |
| WO | 2016/187508 A3 | 1/2017 |
| WO | 2017/106638 A1 | 6/2017 |
| WO | 2017/151940 A2 | 9/2017 |
| WO | 2017/173321 A1 | 10/2017 |
| WO | 2017/184590 A1 | 10/2017 |
| WO | 2017/192924 A1 | 11/2017 |
| WO | 2017/220463 A1 | 12/2017 |
| WO | 2017/221031 A1 | 12/2017 |
| WO | 2018/028438 A1 | 2/2018 |
| WO | 2018/039131 A1 | 3/2018 |
| WO | 2018/098362 A1 | 5/2018 |
| WO | 2018/102585 A1 | 6/2018 |
| WO | 2018/104911 A1 | 6/2018 |
| WO | 2018/104919 A1 | 6/2018 |
| WO | 2018/116193 A1 | 6/2018 |
| WO | 2018/119115 A1 | 6/2018 |
| WO | 2018/187356 A2 | 10/2018 |
| WO | 2018/208856 A1 | 11/2018 |
| WO | 2018/227030 A1 | 12/2018 |
| WO | 2018/232330 A1 | 12/2018 |
| WO | 2019/090156 A1 | 5/2019 |
| WO | 2019/170773 A1 | 9/2019 |
| WO | 2019/226939 A1 | 11/2019 |
| WO | 2019/226941 A1 | 11/2019 |
| WO | 2020/097393 A1 | 5/2020 |
| WO | 2021/003348 A1 | 1/2021 |
| WO | 2021/092095 A1 | 5/2021 |
| WO | 2021/119545 A1 | 6/2021 |
| WO | 2021/142437 A1 | 7/2021 |
| WO | 2021216775 A2 | 10/2021 |
| WO | 2022/032196 A2 | 2/2022 |

OTHER PUBLICATIONS

Méthot PO, Alizon S. What is a pathogen? Toward a process view of host-parasite interactions. Virulence. 2014;5(8):775-85. (Year: 2014).*

PCT/US2020/035591—International Preliminary Report on Patentability, Nov. 16, 2021.

Nezafat et al., "A novel multi-epitope peptide vaccine against cancer: an in silico approach." Journal of theoretical biology 349 (2014): 121-134.

Mohammed et al., "Phosphorylation-dependent interaction between antigenic peptides and MHC class I: a molecular basis for the presentation of transformed self." Nature immunology 9, No. 11 (2008): 1236-1243.

Toes et al., "Protective anti-tumor immunity induced by vaccination with recombinant adenoviruses encoding multiple tumor-associated cytotoxic T lymphocyte epitopes in a string-of-beads fashion." Proceedings of the National Academy of Sciences 94, No. 26 (1997): 14660-14665.

Wei et al., "Dendritic cells expressing a combined PADRE/MUC4-derived polyepitope DNA vaccine induce multiple cytotoxic T-cell

(56) References Cited

OTHER PUBLICATIONS responses." Cancer biotherapy & radiopharmaceuticals Feb. 2008;23(1):121-8.
Meko'o et al., "Immunopreventive effects against murine H22 hepatocellular carcinoma in vivo by a DNA vaccine targeting a gastrin-releasing peptide." Asian Pacific Journal of Cancer Prevention 15, No. 20 (2014): 9039-9043.
Huang et al., "DNA vaccines for cervical cancer," American Journal of Translational Research, Jan. 2, 2010;2(1):75-87.
Behrens et al., "Antibody-Drug Conjugates (ADCs) Derived from Interchain Cysteine Cross-Linking Demonstrate Improved Homogeneity and Other Pharmacological Properties over Conventional Heterogeneous ADCs," Molecular Pharmaceutics 12 (11) ( ): 3986-3998, Nov. 2, 2015.
Koizume et al., "Tissue Factor—Factor VII Complex As a Key Regulator of Ovarian Cancer Phenotypes," Biomarkers in Cancer vol. 7, pp. 1-13, Aug. 5, 2015.
Schumacher et al., "Neoantigens in cancer immunotherapy," Science vol. 348, Issue 6230, pp. 69-74, Apr. 3, 2015.
Rivas et al., "Effect of predicted protein-truncating genetic variants on the human transcriptome," Science vol. 348, No. 6235, pp. 666-669, May 8, 2015.
Lundstrom, Kenneth. "Alphavirus-based vaccines." Current opinion in molecular therapeutics 4, No. 1 (Feb. 2002): 28-34.
Alexander et al., "Linear PADRE T helper epitope and carbohydrate B cell epitope conjugates induce specific high titer IgG antibody responses." The Journal of Immunology 164, No. 3 (Feb. 2000): 1625-1633.
Kim et al., "Neopepsee: accurate genome-level prediction of neoantigens by harnessing sequence and amino acid immunogenicity information." Annals of Oncology 29, No. 4 (Apr. 2018): 1030-1036.
Ott et al., "An immunogenic personal neoantigen vaccine for patients with melanoma." Nature 547, No. 7662 (Jul. 2017): 217-221.
Gen Bank: AF394196.1—Simian adenovirus 25, complete genome, 15 pages, 2001.
Fluet et al., "Effects of rapid antigen degradation and VEE glycoprotein specificity on immune responses induced by a VEE replicon vaccine." Virology 370, No. 1 (Jan. 2008): 22-32.
Ogawa et al., "An Attempt of Cytokine Gene Therapy Using Adenovirus Vectors," Partial Translation of: Biotherapy, 1998, vol. 12 No. 5, p. 785-787.
Nielsen et al., "An in vitro-transcribed-mRNA polyepitope construct encoding 32 distinct HLA class I-restricted epitopes from CMV, EBV, and Influenza for use as a functional control in human immune monitoring studies." Journal of immunological methods 360, No. 1-2 (2010): 149-156.
Bergmann et al., "Differential effects of flanking residues on presentation of epitopes from chimeric peptides." Journal of virology 68, No. 8 (1994): 5306-5310.
Carroll et al., "Alphavirus replicon-based adjuvants enhance the immunogenicity and effectiveness of Fluzone in rhesus macaques." Vaccine 29, No. 5 (2011): 931-940.
Thompson et al., "The contribution of type I interferon signaling to immunity induced by alphavirus replicon vaccines." Vaccine 26, No. 39 (2008): 4998-5003.
Ljungberg et al., "Increased immunogenicity of a DNA-launched Venezuelan equine encephalitis virus-based replicon DNA vaccine." Journal of virology 81, No. 24 (2007): 13412-13423.
Channon et al., "Improved adenoviral vectors: cautious optimism for gene therapy." QJM: monthly journal of the Association of Physicians 90, No. 2 (1997): 105-109.
Gao et al., "Biology of adenovirus vectors with E1 and E4 deletions for liver-directed gene therapy." Journal of virology 70, No. 12 (1996): 8934-8943.
Andrews et al., "Generation and characterization of E1/E2a/E3/E4-deficient adenoviral vectors encoding human factor VIII." Molecular Therapy 3, No. 3 (2001): 329-336.
Farina et al., "Replication-defective vector based on a chimpanzee adenovirus." Journal of virology 75, No. 23 (2001): 11603-11613.
Sakuma et al., "Lentiviral vectors: basic to translational," Biochemical Journal 443, No. 3 (2012): 603-618.
Cooper et al., "Rescue of splicing-mediated intron loss maximizes expression in lentiviral vectors containing the human ubiquitin C promoter," Nucleic Acids Research vol. 43, No. 1, pp. 682-690, Dec. 17, 2014.
Zufferey et al., "Self-Inactivating Lentivirus Vector for Safe and Efficient In Vivo Gene Delivery," Journal of Virology vol. 72, No. 12, pp. 9873-9880, 1998.
Gros et al., "Prospective identification of neoantigen-specific lymphocytes in the peripheral blood of melanoma patients," Nature Medicine vol. 22, Issue 4, pp. 433-438, Feb. 22, 2016.
Strønen et al., "Targeting of cancer neoantigens with donor-derived T cell receptor repertoires," Science 352, No. 6291 (May 19, 2016): 1337-1341.
Lu et al., "Efficient identification of mutated cancer antigens recognized by T cells associated with durable tumor regressions," Clinical Cancer Research vol. 20, No. 13, pp. 3401-3410, 2014.
Stover et al., "New use of BCG for recombinant vaccines," Nature vol. 351, No. 6326, pp. 456-460, 1991.
Boshart et al., "A Very Strong Enhancer is Located Upstream of an Immediate Early Gene of Human Cytomegalovirus," Cell vol. 41, No. 2, 521-530, 1985.
Kost et al., "The nucleotide sequence of the chick cytoplasmic b-actin gene," Nucleic Acids Research vol. 11, No. 23, pp. 8287-8301, 1983.
Shukla et al., "Comprehensive analysis of cancer-associated somatic mutations in class I HLA genes," Nature Biotechnology vol. 33, No. 11. pp. 1152-1158, Nov. 2015.
Mcgranahan et al., "Allele-specific HLA loss and immune escape in lung cancer evolution," Cell vol. 171, No. 6, pp. 1259-1271, 2017.
Van Loo et al., "Allele-specific copy number analysis of tumors," Proceedings of the National Academy of Sciences, vol. 107, No. 39, pp. 16910-16915, 2010.
Desrichard et al., "Cancer neoantigens and applications for immunotherapy," Clinical Cancer Research vol. 22, No. 4, pp. 807-812, Feb. 15, 2016.
Gubin et al., "Tumor neoantigens: Building a framework for personalized cancer immunotherapy," The Journal of Clinical Investigation, vol. 125, No. 9, pp. 3413-3421, Sep. 2015.
Rizvi et al., "Mutational landscape determines sensitivity to PD-1 blockade in non-small cell lung cancer," Science, Apr. 3, 2015;348(6230):1-12.
Snyder et al., "Genetic Basis for Clinical Response to CTLA-4 Blockade in Melanoma," New England Journal of Medicine, vol. 371, No. 23, pp. 2189-2199, 2014.
Carreno et al., "A dendritic cell vaccine increases the breadth and diversity of melanoma neoantigen-specific T cells." Science, May 15, 2015;348(6236):803-8.
Tran et al., "Cancer Immunotherapy Based on Mutation-Specific CD4+ T Cells in a Patient with Epithelial Cancer," Science vol. 344, No. 6184, pp. 641-645, 2014.
Lundegaard et al., "State of the art and challenges in sequence based T-cell epitope prediction," Immunome Research vol. 6, No. 2, pp. 1-14, 2010.
Yadav et al., "Predicting immunogenic tumour mutations by combining mass spectrometry and exome sequencing," Nature, vol. 515, No. 7528, pp. 572-576, 2014.
Bassani-Sternberg et al., "Mass Spectrometry of Human Leukocyte Antigen Class I Peptidomes Reveals Strong Effects of Protein Abundance and Turnover on Antigen Presentation," Molecular & Cellular Proteomics Vo. 14, Issue 3, 658-673, Mar. 1, 2015.
Van Allen et al., "Genomic correlates of response to CTLA-4 blockade in metastatic melanoma," Science vol. 350, No. 6257, pp. 207-211, Nov. 11, 2015.
Yoshida et al., "Splicing factor mutations and cancer," Wiley Interdisciplinary Reviews: RNA 5, No. 4 (2014):445-459.
Cancer Genome Atlas Research Network, "Comprehensive molecular profiling of lung adenocarcinoma," Nature, vol. 511, pp. 543-550, 2014.
Rajasagi et al., "Systematic identification of personal tumor-specific neoantigens in chronic lymphocytic leukemia," Blood, vol. 124, No. 3, pp. 453-462, 2014.

(56) References Cited

OTHER PUBLICATIONS

Cieslik et al., "The use of exome capture RNA-seq for highly degraded RNA with application to clinical cancer sequencing," Genome Research vol. 25, No. 9, 1372-1381, Sep. 1, 2015.
Bodini et al., "The hidden genomic landscape of acute myeloid leukemia: subclonal structure revealed by undetected mutations," Blood, The Journal of the American Society of Hematology vol. 125, No. 4 (Jan. 22, 2015): 600-605.
Saunders et al., Strelka: accurate somatic small-variant calling from sequenced tumor-normal sample pairs, Bioinformatics vol. 28, No. 14, pp. 1811-1817, 2012.
Cibulskis et al., "Sensitive detection of somatic point mutations in impure and heterogeneous cancer samples," Nature Biotechnology vol. 31, No. 3, pp. 213-219, 2013.
Wilkerson et al., "Integrated RNA and DNA sequencing improves mutation detection in low purity tumors," Nucleic Acids Research, Jul. 2014;42(13):1-12.
Mose et al., "ABRA: improved coding indel detection via assembly-based realignment," Bioinformatics, vol. 30, No. 19, pp. 2813-2815, 2014.
Ye et al., "Pindel: a pattern growth approach to detect break points of large deletions and medium sized insertions from paired-end short reads," Bioinformatics vol. 25, No. 21, pp. 2865-2871, 2009.
Lam et al., "Nucleotide-resolution analysis of structural variants using BreakSeq and a breakpoint library," Nature Biotechnology vol. 28, No. 1, pp. 47-55 2010.
Frampton et al., "Development and validation of a clinical cancer genomic profiling test based on massively parallel DNA sequencing," Nature Biotechnology Nov. 2013;31(11):1023-31.
Boegel et al., "HLA typing from RNA-Seq sequence reads," Genome Medicine, Dec. 22, 2012;4(12):1-12.
Liu et al., "ATHLATES: accurate typing of human leukocyte antigen through exome sequencing," Nucleic Acids Research Aug. 2013;41(14):1-8.
Mayor et al., "HLA typing for the next generation," PLoS One, May 27, 2015;10(5):1-12.
Roy et al., "Assessing long-distance RNA sequence connectivity via RNA-templated DNA-DNA ligation," Elife. Apr. 13, 2015;4:1-21.
Song et al., "CLASS: constrained transcript assembly of RNA-seq reads," BMC Bioinformatics, BioMed Central, 2013;14 Suppl 5(Suppl 5):1-8.
Maretty et al. "Bayesian transcriptome assembly," Genome Biology, 2014;15(10):1-11.
Pertea et al., "StringTie enables improved reconstruction of a transcriptome from RNA-seq reads," Nature Biotechnology vol. 33, No. 3, pp. 290-295, Mar. 2015.
Roberts et al., "Identification of novel transcripts in annotated genomes using RNA-Seq," Bioinformatics vol. 27, No. 17, pp. 2325-2329, 2011.
Vitting-Seerup et al., "spliceR: an R package for classification of alternative splicing and prediction of coding potential from RNA-seq data," BMC Bioinformatics, vol. 15, Issue 1, pp. 1-7, 2014.
Skelly et al., "A powerful and flexible statistical framework for testing hypotheses of allele-specific gene expression from RNA-seq data," Genome Research vol. 21, No. 10, pp. 1728-1737, 2011.
Anders et al., "HTSeq-a Python framework to work with high-throughput sequencing data." Bioinformatics vol. 31, No. 2 (Jan. 15, 2015): 166-169.
Furney et al., "SF3B1 Mutations Are Associated with Alternative Splicing in Uveal Melanoma," Cancer Discovery vol. 3, Issue 10, pp. 1122-1129, 2013.
Zhou et al., "A Chemical Genetics Approach for the Functional Assessment of Novel Cancer Genes," Cancer Research vol. 75, No. 10, pp. 1949-1958, May 15, 2015.
Maguire et al., "SF3B1 mutations constitute a novel therapeutic target in breast cancer," The Journal of Pathology vol. 235, No. 4 pp. 571-580, Mar. 2015.
Carithers et al., "A Novel Approach to High-Quality Postmortem Tissue Procurement: The GTEx Project," Biopreservation and Biobanking, vol. 13, No. 5, 311-319, Oct. 1, 2015.

Xu et al., "RNA CoMPASS: A Dual Approach for Pathogen and Host Transcriptome Analysis of RNA-Seq Datasets," PloS ONE, vol. 9, Issue 2, p. e89445, 2014.
Roshorm, et al., "T cells induced by recombinant chimpanzee adenovirus alone and in prime-boost regimens decrease chimeric EcoHIV/NDK challenge virus load," Eur J Immunol. Dec. 2012;42(12):3243-55.
Morris et al., "Simian adenoviruses as vaccine vectors," Future Virol. Sep. 2016;11(9):649-659.
Leppard, Keith N. "E4 gene function in adenovirus, adenovirus vector and adeno-associated virus infections", Journal of General Virology, 1997, vol. 78, pp. 2131-2138.
GSO-033CN Search Report Translation.
Andreatta et al., "Gapped sequence alignment using artificial neural networks: application to the MHC class I system," Bioinformatics, Feb. 15, 2016;32(4):511-7.
Jørgensen et al., "NETMHCSTAB-predicting stability of peptide—MHC-I complexes; impacts for cytotoxic T lymphocyte epitope discovery," Immunology vol. 141, No. 1, pp. 18-26, 2014.
Larsen et al., "An integrative approach to CTL epitope prediction: a combined algorithm integrating MHC class I binding, TAP transport efficiency, and proteasomal cleavage predictions," European Journal of Immunology, vol. 35, No. 8, pp. 2295-2303, 2005.
Nielsen et al., "The role of the proteasome in generating cytotoxic T-cell epitopes: insights obtained from improved predictions of proteasomal cleavage," Immunogenetics vol. 57, No. 1-2, pp. 33-41, 2005.
Boisvert et al., "A Quantitative Spatial Proteomics Analysis of Proteome Turnover in Human Cells," Molecular & Cellular Proteomics, Mar. 2012;11(3):1-15.
Duan et al., "Genomic and bioinformatic profiling of mutational neoepitopes reveals new rules to predict anticancer immunogenicity," Journal of Experimental Medicine, Oct. 20, 2014;211(11):2231-48.
Calis et al., "Properties of MHC Class I Presented Peptides That enhance immunogenicity." PLoS Comput Biol. vol. 9, Issue 10 (Oct. 24, 2013): e1003266, 13 pages.
Zhang et al., "Intra-tumor Heterogeneity in Localized Lung Adenocarcinomas Delineated by Multi-region Sequencing," Science vol. 346, No. 6206, pp. 256-259, 2014.
Walter et al., "Clonal Architecture of Secondary Acute Myeloid Leukemia," New England Journal of Medicine, vol. 366, Issue 12, pp. 1090-1098, 2012.
Hunt et al., "Characterization of Peptides Bound to the Class I MHC Molecule HLA-A2. 1 by Mass Spectrometry," Science vol. 255, pp. 1261-1263, 1992.
Zarling et al., "Identification of class I MHC-associated phosphopeptides as targets for cancer immunotherapy," Proceedings of the National Academy of Sciences, vol. 103, No. 40, pp. 14889-14894, 2006.
Abelin et al., "Complementary IMAC enrichment methods for HLA-associated phosphopeptide identification by mass spectrometry," Nature Protocols 10(9) (2015): 1308-1318.
Barnstable et al., "Production of Monoclonal Antibodies to Group A Erythrocytes, HLA and Other Human Cell Surface Antigens—New Tools for Genetic Analysis," Cell vol. 14, 9-20, 1978.
Goldman et al., "HLA-DA monoclonal antibodies inhibit the proliferation of normal and chronic granulocytic leukaemia myeloid progenitor cell," British Journal of Haematology 52, No. 3 (1982): 411-420.
Eng et al., "Comet: An open-source MS/MS sequence database search tool," Proteomics vol. 13, No. 1, pp. 22-24, 2013.
Eng et al., "A Deeper Look into Comet—Implementation and Features," Journal of the American Society for Mass Spectrometry vol. 26, No. 11, pp. 1865-1874, 2015.
Käll et al., "Semi-supervised learning for peptide identification from shotgun proteomics datasets," Nature Methods vol. 4, No. 11, pp. 923-925, 2007.
Käll et al., "Assigning Significance to Peptides Identified by Tandem Mass Spectrometry Using Decoy Databases," Journal of Proteome Research vol. 7, No. 01, pp. 29-34, 2008.
Käll et al., "Non-parametric estimation of posterior error probabilities associated with peptides identified by tandem mass spectrometry," Bioinformatics vol. 24, No. 16, pp. i42-i48, 2008.

(56) References Cited

OTHER PUBLICATIONS

Kinney et al., "Nucleotide sequence of the 26 S mRNA of the virulent Trinidad donkey strain of Venezuelan equine encephalitis virus and deduced sequence of the encoded structural proteins," Virology 152, No. 2 (1986): 400-413.

Slansky et al., "Enhanced Antigen-Specific Antitumor Immunity with Altered Peptide Ligands that Stabilize the MHC-Peptide-TCR Complex," Immunity vol. 13, No. 4, pp. 529-538, 2000.

Huang et al., "The immunodominant major histocompatibility complex class I-restricted antigen of a murine colon tumor derives from an endogenous retroviral gene product," Proceedings of the National Academy of Sciences vol. 93, No. 18, pp. 9730-9735, 1996.

Johnson et al., "Molecular Determinants of Alphavirus Neurovirulence: Nucleotide and Deduced Protein Sequence Changes during Attenuation of Venezuelan Equine Encephalitis Virus," Journal of General Virology vol. 67, Issue 9, pp. 1951-1960, 1986.

Aarnoudse et al., "TCR reconstitution in Jurkat reporter cells facilitates the identification of novel tumor antigens by cDNA expression clonin," International Journal of Vancer, May 1, 2002;99(1):7-13.

Alexander et al., "Development of High Potency Universal DR-Restricted Helper Epitopes by Modification of High Affinity DR-Blocking Peptides." Immunity vol. 1, Issue 9 (1994): 751-761.

Banu et al., "Building and Optimizing a Virus-specific T Cell Receptor Library for Targeted Immunotherapy in Viral Infections." Scientific Reports, Feb. 25, 2014;4:1-10.

Cornet et al., "Optimal organization of a polypeptide-based candidate cancer vaccine composed of cryptic tumor peptides with enhanced immunogenicity," Vaccine vol. 24, No. 12, pp. 2102-2109, 2006.

Depla et al., "Rational Design of a Multiepitope Vaccine Encoding T-Lymphocyte Epitopes for Treatment of Chronic Hepatitis B Virus Infections," Journal of Virology vol. 82, No. 1, pp. 435-450, 2008.

Ishioka et al., "Utilization of MHC Class I Transgenic Mice for Development of Minigene DNA Vaccines Encoding Multiple HLA-Restricted CTL Epitopes," The Journal of Immunology vol. 162, No. 7, pp. 3915-3925, 1999.

Janetzki et al., "Guidelines for the automated evaluation of Elispot assays," Nature Protocols vol. 10, No. 7, pp. 1098-1115, Jul. 2015.

Lyons et al., "Influence of Human CD8 on Antigen Recognition by T-Cell Receptor-Transduced Cells," Cancer Research vol. 66, No. 23, pp. 11455-11461, 2006.

Nagai et al., "Aurora kinase A-specific T-cell receptor gene transfer redirects T lymphocytes to display effective antileukemia reactivity," Blood, The Journal of the American Society of Hematology, vol. 119, No. 2, pp. 368-376, 2012.

Panina-Bordignon et al., "Universally immunogenic T cell epitopes: promiscuous binding to human MHC class II and promiscuous recognition by T cells," European Journal of Immunology 19, No. 12 (1989): 2237-2242.

Vitiello et al., "Analysis of the HLA-restricted Influenza-specific Cytotoxic T Lymphocyte Response in Transgenic Mice Carrying a Chimeric Human-Mouse Class I Major Histocompatibility Complex," The Journal of Experimental Medicine, vol. 173, No. 4, pp. 1007-1015, 1991.

Yachi et al., "Altered Peptide Ligands Induce Delayed CD8-T Cell Receptor Interaction—a Role for CD8 in Distinguishing Antigen Quality," Immunity vol. 25, No. 2, pp. 203-211, 2006.

Pushko et al., "Replicon-Helper Systems from Attenuated Venezuelan Equine Encephalitis Virus: Expression of Heterologous Genes in Vitro and Immunization against Heterologous Pathogens in Vivo," Virology vol. 239, No. 2, pp. 389-401, 1997.

Strauss et al., "The Alphaviruses: Gene Expression, Replication, and Evolution," Microbiological Reviews, vol. 58, No. 3, pp. 491-562, 1994.

Rhême et al., "Alphaviral cytotoxicity and its implication in vector development," Experimental Physiology vol. 90, No. 1, pp. 45-52, 2005.

Riley et al., "Recent advances in nanomaterials for gene delivery—a review," Nanomaterials, Apr. 28, 2017;7(5):1-19.

Frolov et al., "Cis-acting RNA elements at the 5' end of Sindbis virus genome RNA regulate minus- and plus-strand RNA synthesis," RNA vol. 7, No. 11, pp. 1638-1651, 2001.

Jose et al., "A structural and functional perspective of alphavirus replication and assembly," Future Microbiology, vol. 4, No. 7, pp. 837-856, 2009.

Li et al., "RSEM: accurate transcript quantification from RNA-Seq data with or without a reference genome." BMC bioinformatics 12, No. 1 (2011): 323, 16 pages.

Pearson et al., "MHC class I-associated peptides derive from selective regions of the human genome," The Journal of Clinical Investigation, vol. 126, No. 12, pp. 4690-4701, Dec. 1, 2016.

Mommen et al., "Sampling from the Proteome to the Human Leukocyte Antigen-DR (HLA-DR) Ligandome ProceedsVia High Specificity," Molecular & Cellular Proteomics, vol. 15, No. 4, pp. 1412-1423, Apr. 1, 2016.

Kreiter et al., "Mutant MHC class II epitopes drive therapeutic immune responses to cancer," Nature, vol. 520, No. 7549, pp. 692-696, Apr. 2015.

Andreatta et al., "Accurate pan-specific prediction of peptide-MHC class II binding affinity with improved binding core identification." Immunogenetics 67, No. 11-12 (Nov. 2015): 641-650.

Nielsen et al., "NN-align. An artificial neural network-based alignment algorithm for MHC class II peptide binding prediction," BMC Bioinformatics, Sep. 18, 2009;10:1-10.

Nielsen et al., "Prediction of MHC class II binding affinity using SMM-align, a novel stabilization matrix alignment method," BMC Bioinformatics, Jul. 4, 2007;8:1-12.

Zhang, et al., "PEAKS DB: De Novo Sequencing Assisted Database Search for Sensitive and Accurate Peptide Identification," Molecular & Cellular Proteomics, Apr. 2012;11(4):1-8.

Jensen et al., "Improved methods for predicting peptide binding affinity to MHC class II molecules," Immunology vol. 154, Issue 3, pp. 394-406, 2018.

PCT/US2020/035591—International Search Report and Written Opinion, Sep. 9, 2020, 17 pages.

Ngo et al., "CNTO 859, a humanized anti-tissue factor monoclonal antibody, is a potent inhibitor of breast cancer metastasis and tumor growth in xenograft models," International Journal of Cancer, vol. 120, No. 6, pp. 1261-1267, 2007.

Hong et al, Immuno-PET of Tissue Factor in Pancreatic Cancer, J Nucl Med, vol. 53, No. 11, pp. 1748-1754, 2012.

Trail et al., "Antibody drug conjugates for treatment of breast cancer: Novel targets and diverse approaches in ADC design," Pharmacol. Ther., vol. 181, pp. 126-142, 2018.

De Graaf et al., Beta-Glucuronidase-Mediated Drug Release, Curr Pharm Des., vol. 8, pp. 1391-1403, 2002.

Chari et al., Immunoconjugates Containing Novel Maytansinoids: Promising Anticancer Drugs, Cancer Research, vol. 52, pp. 127-131, 1992.

Kovtun et al., "Antibody-Mytansinoid Conjugates Designed to Bypass Multidrug Resistance," Cancer Research vol. 70, No. 6, pp. 2528-2537, 2010.

Vitetta et al., "Redesigning Nature's Poisons to Create Anti-Tumor Reagents," Science vol. 238, No. 4830, pp. 1098-1104, 1987.

Junutula et al., "Rapid identification of reactive cysteine residues for site-specific labeling of antibody-Fabs," Journal of Immunological Methods 332, No. 1-2 (2008): 41-52.

Junutula et al., "Site-specific conjugation of a cytotoxic drug to an antibody improves the therapeutic index." Aug. 2008;26(8):925-32.

Hofer et al., "An engineered selenocysteine defines a unique class of antibody derivatives," Proc. Natl. Acad. Sci. USA, 2008, 105:12451-12456.

Hofer et al., Molecularly defined antibody conjugation through a selenocysteine interface, Biochemistry, vol. 48, No. 50, pp. 12047-12057, 2009.

Hjortoe et al., Tissue factor-factor VIIa-specific up-regulation of IL-8 expression in MDA-MB-231 cells is mediated by PAR-2 and results in increased cell migration, Blood, 2004, vol. 103, No. 8, pp. 3029-3037.

(56) References Cited

OTHER PUBLICATIONS

Sakurai et al., "Expression of Tissue Factor in Epithelial Ovarian Carcinoma is Involved in the Development of Venous Thromboembolism," International Journal of Gynecologic Cancer, vol. 27, No. 1, pp. 37-43, 2017.

Cocco et al., "Expression of Tissue factor in Adenocarcinoma and Squamous Cell Carcinoma of the Uterine Cervix: Implications for immunotherapy with hI-con1, a factor VII-IgGFc chimeric protein targeting tissue factor," BMC Cancer, Jun. 22, 2011;11:1-10.

Christensen et al., "Urokinase-type plasminogen activator receptor (uPAR), tissue factor (TF) and epidermal growth factor receptor (EGFR): tumor expression patterns and prognostic value in oral cancer," BMC Cancer, Aug. 25, 2017;17(1):1-12.

Yao et al., Tissue Factor and VEGF Expression in Prostate Carcinoma A Tissue Microarray Study, Cancer Invest., vol. 27, pp. 430-434, 2009.

Abdulkadir et al., "Tissue factor expression and angiogenesisin human prostate carcinoma," Human Pathology 31, No. 4 (2000): 443-447.

Zhang et al., "Pathological expression of tissue factor confers promising antitumor response to a novel therapeutic antibody SC1 in triple negative breast cancer and pancreatic adenocarcinoma," Oncotarget vol. 8, No. 35, pp. 59086-59102, 2017.

Guan et al., "Tissue factor expression and angiogenesis in human glioma." Clinical Biochemistry 35, No. 4 (2002): 321-325.

Carneiro-Lobo et al., Ixolaris, a tissue factor inhibitor, blocks primary tumor growth and angiogenesis in a glioblastoma model, J Thromb Haemost, 2009, 7:1855-1864.

Yeh et al., "Upregulation of Tissue Factor by Activated Stat3 Contributes to Malignant Pleural Effusion Generation via Enhancing Tumor Metastasis and Vascular Permeability in Lung Adenocarcinoma," PLoS One, Sep. 27, 2013;8(9):1-14.

Regina et al., "Increased tissue factor expression is associated with reduced survival in non-small cell lung cancer and with mutations of TP53 and PTEN," Clinical Chemistry, vol. 55, No. 10, pp. 1834-1842, 2009.

Lo et al., "Tissue factor expression in the metaplasia-adenoma-carcinoma sequence of gastric cancer in a European population," British Journal of Cancer vol. 107, No. 7, pp. 1125-1130, 2012.

Chen et al., "Immunolocalisation of tissue factor in esophageal cancer is correlated with intratumoral angiogenesis and prognosis of the patient." Acta Histochemica 112, No. 3 (2010): 233-239.

Patry et al., "Tissue factor expression correlates with disease-specific survival in patients with node-negative muscle-invasive bladder cancer," International Journal of Cancer, vol. 122, No. 7, pp. 1592-1597, 2008.

Bromberg et al., Tissue factor promotes melanoma metastasis by a pathway independent of blood coagulation, Proc Natl Acad Sci U S A., 1995, 92:8205-8209.

Silva et al., "Increased Tissue Factor Expression is an Independent Predictor of Mortality in Clear Cell Carcinoma of the Kidney," Int Braz J Urol., 2014, 40:499-506.

Van Den Berg et al., "The relationship between tissue factor and cancer progression: insights from bench and bedside," Blood vol. 119, No. 4, pp. 924-932, 2012.

Tripisciano et al., "Different Potential of Extracellular Vesicles to Support Thrombin Generation: Contributions of Phosphatidylserine, Tissue Factor, and Cellular Origin," Scientific Reports vol. 7, No. 1, pp. 1-11, 2017.

Teplyakov et al., "Crystal structure of tissue factor in complex with antibody 10H10 reveals the signaling epitope," Cellular Signalling vol. 36, pp. 139-144, 2017.

Liepe et al., "A large fraction of HLA class I ligands are proteasome-generated spliced peptides," Science vol. 354, No. 6310, Oct. 21, 2016.

Smith et al., "Comparison of biosequences," Advances in Applied Mathematics vol. 2, No. 4, pp. 482-489, 1981.

Needleman et al., "A General Method Applicable to the Search for Similarities in the Amino Acid Sequence of Two Proteins," Journal of Molecular Biology, vol. 48, No. 3, pp. 443-453, 1970.

Pearson et al., "Improved tools for biological sequence comparison," Proceedings of the National Academy of Sciences, vol. 85, No. 8, pp. 2444-2448, 1988.

Altschul et al., "Basic Local Alignment Search Tool." Journal of Molecular Biology vol. 215, Issue 3 (1990): 403-410.

Kornher et al., "Mutation detection using nucleotide analogs that alter electrophoretic mobility," Nucleic Acids Research vol. 17, No. 19, pp. 7779-7784, 1989.

Sokolov, "Primer extension technique for the detection of single nucleotide in genomic DNA," Nucleic Acids Research, Jun. 25, 1990;18(12):3671.

Syvänen et al., "A Primer-Guided Nucleotide Incorporation Assay in the Genotyping of Apolipoprotein E," Genomics 8, No. 4 (1990): 684-692.

Kuppuswamy et al., "Single nucleotide primer extension to detect genetic diseases: experimental application to hemophilia B (factor IX) and cystic fibrosis genes," Proceedings of the National Academy of Sciences vol. 88, No. 4, pp. 1143-1147, 1991.

Prezant et al., "Trapped-Oligonucleotide Nucleotide Incorporation (TONI) Assay, a Simple Method for Screening Point Mutations," Human Mutation 1, No. 2 (1992): 159-164.

Ugozzoli et al., "Detection of specific alleles by using allele-specific primer extension followed by capture on solid support," Genetic Analysis: Biomolecular Engineering 9, No. 4 (1992): 107-112.

Nyrén et al., "Solid phase DNA minisequencing by an enzymatic luminometric inorganic pyrophosphate detection assay." Analytical Biochemistry 208, No. 1 (1993): 171-175.

Syvänen et al., "Identification of Individuals by Analysis of Biallelic DNA Markers, Using PCR and Solid-Phase Minisequencing," American Journal of Human Genetics Jan. 1993;52(1):46-59.

Merrifield, "Solid phase synthesis." Science 232 (1986): 341-348.

Dupuis et al., "Dendritic cells internalize vaccine adjuvant after intramuscular injection," Cellular Immunology 186, No. 1 (1998), 18-27.

Allison, "The mode of action of immunological adjuvants," Developments in Biological Standardization 92 (1998): 3-11.

Gabrilovich et al., "IL-12 and Mutant P53 Peptide-Pulsed Dendritic Cells for the Specific Immunotherapy of Cancer," Journal of Immunotherapy, vol. 19, No. 6 (1996): 414-418.

Tatsis et al., "Adenoviruses as vaccine vectors," Molecular Therapy vol. 10, No. 4, pp. 616-629, 2004.

Hu et al., "Immunization Delivered by Lentiviral Vectors for Cancer and Infectious Diseases," Immunological Reviews, vol. 239, Issue 1, pp. 45-61, 2011.

Carter et al., "Absolute quantification of somatic DNA alterations in human cancer," Nature Biotechnology vol. 30, No. 5, 413-421, 2012.

Qiu et al., "Reviving virus based cancer vaccines by using cytomegalovirus vectors expressing modified tumor antigens," OncoImmunology Jun. 5, 2015;5(1):1-4.

Farina et al., "Replication-Defective Vector Based on a Chimpanzee Adenovirus," Journal of Virology vol. 75, No. 23, pp. 11603-11613, 2001.

Ljungberg et al., "Self-replicating alphavirus RNA vaccines," Expert Review of Vaccines vol. 14, No. 2, pp. 177-194, Feb. 1, 2015.

Lundstrom, "Alphavirus-Based Vaccines," Viruses vol. 6, No. 6, pp. 2392-2415, 2014.

Geall et al., "Nonviral delivery of self-amplifying RNA vaccines," Proceedings of the National Academy of Sciences, vol. 109, Issue 36, pp. 14604-14609, 2012.

Rodriguez et al., "DNA Immunization with Minigenes: Low Frequency of Memory Cytotoxic T Lymphocytes and Inefficient Antiviral Protection Are Rectified by Ubiquitination," Journal of Virology vol. 72, No. 6, pp. 5174-5181, 1998.

Velders et al., "Defined Flanking Spacers and Enhanced Proteolysis Is Essential for Eradication of Established Tumors by an Epitope String DNA Vaccine," The Journal of Immunology, vol. 166, No. 9, pp. 5366-5373, 2001.

Kreiter et al., "Increased Antigen Presentation Efficiency by Coupling Antigens to MHC Class I Trafficking Signals," The Journal of Immunology, vol. 180, No. 1, pp. 309-318, 2008.

Rodriguez et al., "DNA Immunization: Ubiquitination of a Viral Protein Enhances Cytotoxic T-Lymphocyte Induction and Antiviral

(56) References Cited

OTHER PUBLICATIONS

Protection but Abrogates Antibody Induction," Journal of Virology vol. 71, No. 11, pp. 8497-8503, 1997.

James et al., "Tetramer-guided epitope mapping reveals broad, individualized repertoires of tetanus toxin-specific CD4+ T cells and suggests HLA-based differences in epitope recognition," International Immunology vol. 19, No. 11, pp. 1291-1301, 2007.

Jayaraman et al., "Maximizing the Potency of siRNA Lipid Nanoparticles for Hepatic Gene Silencing In Vivo," Angewandte Chemie vol. 51, pp. 8529-8533, 2012.

Démoulins et al., "Polyethylenimine-based polyplex delivery of self-replicating RNA vaccines," Nanomedicine: Nanotechnology, Biology and Medicine vol. 12, No. 3, pp. 711-722, Apr. 1, 2016.

Chahal et al., "Dendrimer-RNA nanoparticles generate protective immunity against lethal Ebola, H1N1 influenza, and Toxoplasma gondii challenges with a single dose," Proceedings of the National Academy of Sciences vol. 113, No. 29 E4133-E4142, Jul. 19, 2016.

Vajdy et al., "Mucosal adjuvants and delivery systems for protein-, DNA- and RNA-based vaccines," Immunology and Cell Biology, vol. 82, No. 6, pp. 617-627, 2004.

Fleeton et al., "Self-Replicative RNA Vaccines Elicit Protection against Influenza A Virus, Respiratory Syncytial Virus, and a Tickborne Encephalitis Virus," The Journal of Infectious Diseases vol. 183, No. 9, pp. 1395-1398, 2001.

Strejan et al., "Suppression of chronic-relapsing experimental allergic encephalomyelitis in strain-13 guinea pigs by administration of liposome-associated myelin basic protein." Journal of Neuroimmunology 7 (1984): 27-41.

Johanning et al., "A Sindbis virus mRNA polynucleotide vector achieves prolonged and high level heterologous gene expression in vivo," Nucleic Aids Research vol. 23, Issue 9, pp. 1495-1501, 1995.

Martinon et al., "Induction of virus-specific cytotoxic T lymphocytes in vivo by liposome-entrapped mRNA," European Journal of Immunology 23, No. 7 (1993): 1719-1722.

Leitner et al., "DNA and RNA-based vaccines: principles, progress and prospects," Vaccine vol. 18, No. 9-10, pp. 765-777, 1999.

Del Val et al., "Efficient Processing of an Antigenic Sequence for Presentation by MHC Class I Molecules Depends on Its Neighboring Residues in the Protein," Cell vol. 66, No. 6, pp. 1145-1153, 1991.

Holzhütter et al., "A Theoretical Approach Towards the Identification of Cleavage-Determining Amino Acid Motifs of the 20S Proteasome," Journal of Molecular Biology, vol. 286, Issue 4, pp. 1251-1265, 1999.

Nussbaum et al., "Cleavage motifs of the yeast 20S proteasome β subunits deduced from digests of enolase 1," Proceedings of the National Academy of Sciences, vol. 95, No. 21, pp. 12504-12509, 1998.

Eggers et al., "The Cleavage Preference of the Proteasome Governs the Yield of Antigenic Peptides," The Journal of Experimental Medicine vol. 182, No. 6, pp. 1865-1870, 1995.

Borthwick et al., "Vaccine-elicited human T cells recognizing conserved protein regions inhibit HIV-1." Molecular therapy 22, No. 2 (2014): 464-475.

Ager et al, "31st Annual Meeting and Associated Programs of the Society for Immunotherapy of Cancer (SITC 2016): part two," in Journal for Immuno Therapy of Cancer, vol. 4, Supplement 1, 2016: 107-221.

Warimwe et al. "Immunogenicity and efficacy of a chimpanzee adenovirus-vectored Rift Valley fever vaccine in mice," Virology Journal vol. 10, No. 1, pp. 1-9, 2013.

Cappuccini et al. "Immunogenicity and efficacy of the novel cancer vaccine based on simian adenovirus and MVA vectors alone and in combination with PD-1 mAb in a mouse model of prostate cancer," Cancer Immunol. Immunother. vol. 65, No. 6, pp. 701-713, Apr. 6, 2016.

Aurisicchio et al., "Immunogenicity and Therapeutic Efficacy of a Dual-Component Genetic Cancer Vaccine Cotargeting Carcinoembryonic Antigen and HER2/neu in Preclinical Models," Human Gene Therapy, vol. 25, Issue 2, pp. 121-131, Feb. 2014.

Morris et al. "Simian adenoviruses as vaccine vectors." Future Virology, vol. 11, No. 9 pp. 649-659, Sep. 15, 2016.

Letourneau et al. "Design and Pre-Clinical Evaluation of a Universal HIV-1 Vaccine," PloS ONE, Oct. 3, 2007;2(10):1-11.

Colloca et al., "Vaccine Vectors Derived from a Large Collection of Simian Adenoviruses Induce Potent Cellular Immunity Across Multiple Species," Science Translational Medicine, Jan. 4, 2012;4(115):1-24.

Levy et al. "A melanoma multiepitope polypeptide induces specific CD8+ T-cell response," Cellular Immunology, vol. 250, No. 1-2, pp. 24-30, 2007.

Tatsis et al. "Chimpanzee-origin adenovirus vectors as vaccine carriers," Gene Therapy vol. 13, No. 5, pp. 421-429, 2006.

Zappasodi et al., "Alphavirus-based vaccines in melanoma: rationale and potential improvements in immunotherapeutic combinations." Immunotherapy 7, No. 9 (Sep. 2015): 981-997.

Riabov et al., "Anti-tumor effect of the alphavirus-based virus-like particlevector expressing prostate-specific antigen in a HLA-DR transgenic mouse model of prostate cancer." Vaccine 33, No. 41 (Oct. 5, 2015): 5386-5395.

Fang et al., "Stable antibody expression at therapeutic levels using the 2A peptide." Nature biotechnology 23, No. 5 (2005): 584-590.

Wu et al., "Targeting genes: delivery and persistent expression of a foreign gene driven by mammalian regulatory elements in vivo." Journal of Biological Chemistry 264, No. 29 (1989): 16985-16987.

Fisher et al., "The transmembrane domain of diphtheria toxin improves molecular conjugate gene transfer." Biochemical Journal 321, No. 1 (1997): 49-58.

Szoka et al., "Comparative properties and methods of preparation of lipid vesicles (liposomes)." Annual review of biophysics and bioengineering 9, No. 1 (1980): 467-508.

Wolff et al., "Direct gene transfer into mouse muscle in vivo." Science 247, No. 4949 (1990): 1465-1468.

Felgner et al., "Lipofection: a highly efficient, lipid-mediated DNA-transfection procedure." Proceedings of the National Academy of Sciences 84, No. 21 (1987): 7413-7417.

Mannino et al., "Liposome mediated gene transfer." Biotechniques 6, No. 7 (1988): 682-690.

Konarska et al., "Recognition of cap structure in splicing in vitro of mRNA precursors." Cell 38, No. 3 (1984): 731-736.

Huang, "Sindbis virus vectors for expression in animal cells." Current Opinion in Biotechnology 7, No. 5 (1996): 531-535.

Wan et al., "High-sensitivity monitoring of ctDNA by patient-specific sequencing panels and integration of variant reads." bioRxiv, Sep. 2019:1-37.

Wang et al., "Identification of T Cell Receptors Targeting KRAS-Mutated Human Tumors", Cancer Immunology Research 4(3) Mar. 2016, pp. 204-214.

Hacohen et al., "Getting personal with neoantigen-based therapeutic cancer vaccines." Cancer immunology research 1, No. 1 (2013): 11-15.

Karasaki et al., "Identification of individual cancer-specific somatic mutations for neoantigen-based immunotherapy of lung cancer." Journal of Thoracic Oncology 11, No. 3 (Mar. 2016): 324-333.

Abbas et al., "Structure of human IFIT1 with capped RNA reveals adaptable mRNA binding and mechanisms for sensing N1 and N2 ribose 2?-O methylations." Proceedings of the National Academy of Sciences 114, No. 11 (2017): E2106-E2115.

* cited by examiner

| # | HLA | Sequence | Origin |
|---|---|---|---|
| 1 | A*0201 | NLVPMVATV | HCMV pp65 (495–503) |
| 2 | A*0201 | CLGGLLTMV | EBV LMP2A (426-434) |
| 3 | A*0201 | GLCTLVAML | EBV BMLF1 (280–288) |
| 4 | A*0201 | LLFGYPVYV | HTLV-1 Tax (11-19) |
| 5 | A*0201 | GILGFVFTL | Influenza A Matrix 1 (58–66) |
|   | MHC-II | AKFVAAWTLKAAA | PADRE (artificial seq) |
|   | MHC-II | QYIKANSKFIGITE | Tetanus toxoid (830-844) |

| #  | HLA     | Sequence   | Origin                      |
|----|---------|------------|-----------------------------|
| 1  | A*02:01 | NLVPMVATV  | HCMV pp65 495-504           |
| 2  | A*02:01 | CLGGLLTMV  | EBV LMP-2 426-434           |
| 3  | A*02:01 | GLCTLVAML  | EBV BMLF-1 259-267          |
| 4  | A*02:01 | LLFGYPVYV  | HTLV1 Tax 11-19             |
| 5  | A*02:01 | GILGFVFTL  | Influenza A MP 58-66        |
| 6  | A*02:01 | DLMGYIPAV  | HCV core 132-140            |
| 7  | A*02:01 | FLPSDFFPSV | HBV core antigen 18-27      |
| 8  | A*02:01 | FLLTRILTI  | HBV envelope 183-191        |
| 9  | A*02:01 | WLSLLVPFV  | HBV surface antigen 172-181 |
| 10 | A*02:01 | FLLSLGIHL  | HBV polymerase 573-581      |
| 11 | A*02:01 | ILKEPVHGV  | HIV-1 RT 476-484            |
| 12 | A*02:01 | YMLDLQPETT | HPV 16 E7 11-20             |
| 13 | A*02:01 | CINGVCWTV  | HCV NS3 1073-1081           |
| 14 | A*02:01 | YLLPRRGPRL | HCV core 35-44              |
| 15 | A*02:01 | FLYALALLL  | EBV LMP-2 356-364           |
| 16 | A*02:01 | AAGIGILTV  | MELAN-A/MART-1 (27-35)      |
| 17 | A*02:01 | SLLMWITQV  | NY-ESO-1(157-165) C9V       |
| 18 | A*03:01 | KLGGALQAK  | CVM-IE1                     |
| 19 | A*03:01 | RLRAEAQVK  | EBV-EBNA-3a                 |
| 20 | B*44:05 | EENLLDFVRF | EBV EBNASC (281-290)        |
| 21 | B*44:05 | EEYLQAFTY  | Self ABCD3 protein          |

FIG 5B

NHP Epitopes

| | MHC | Sequence |
|---|---|---|
| 1 | Mamu*01 | CTPYDINQM |
| 4 | Mamu*01 | TTPESANL |
| 7 | Mamu*01 | CAPPGYALL |
| 10 | Mamu*01 | SGPKTNIIV |
| 14 | Mamu*01 | LSPRTLNAW |
| 18 | Mamu*01 | TVPWPNASL |

Human Epitopes

| | HLA | Sequence |
|---|---|---|
| 3 | A*02:01 | GILGFVFTL |
| 6 | A*02:01 | LLFGYPVYV |
| 9 | A*02:01 | GLCTLVAML |
| 12 | A*02:01 | NLVPMVATV |
| 16 | A*02:01 | CLGGLLTMV |

Murine MHC-I Epitopes

| | MHC | Sequence |
|---|---|---|
| 2 | H-2Kb | SIINFEKL |
| 5 | H-2Ld | SPSYAYHQF |
| 8 | H-2Db | EGPRNQDWL |
| 11 | H-2Kb | DWENVSPEL |
| 13 | H-2Kb | SIIVFNLL |
| 15 | H-2Db | ASMTNMELM |
| 17 | H-2Db | AQLANDVVL |
| 19 | H-2Kb | SVYDFFVWL |
| 20 | H-2Ld | MNKYAYHML |

Universal MHC-II Epitopes

| | HLA | Sequence |
|---|---|---|
| 1 | MHC-II | AKFVAAWTLKAAA |
| 2 | MHC-II | QYIKANSKFIGITEL |

FIG 6B

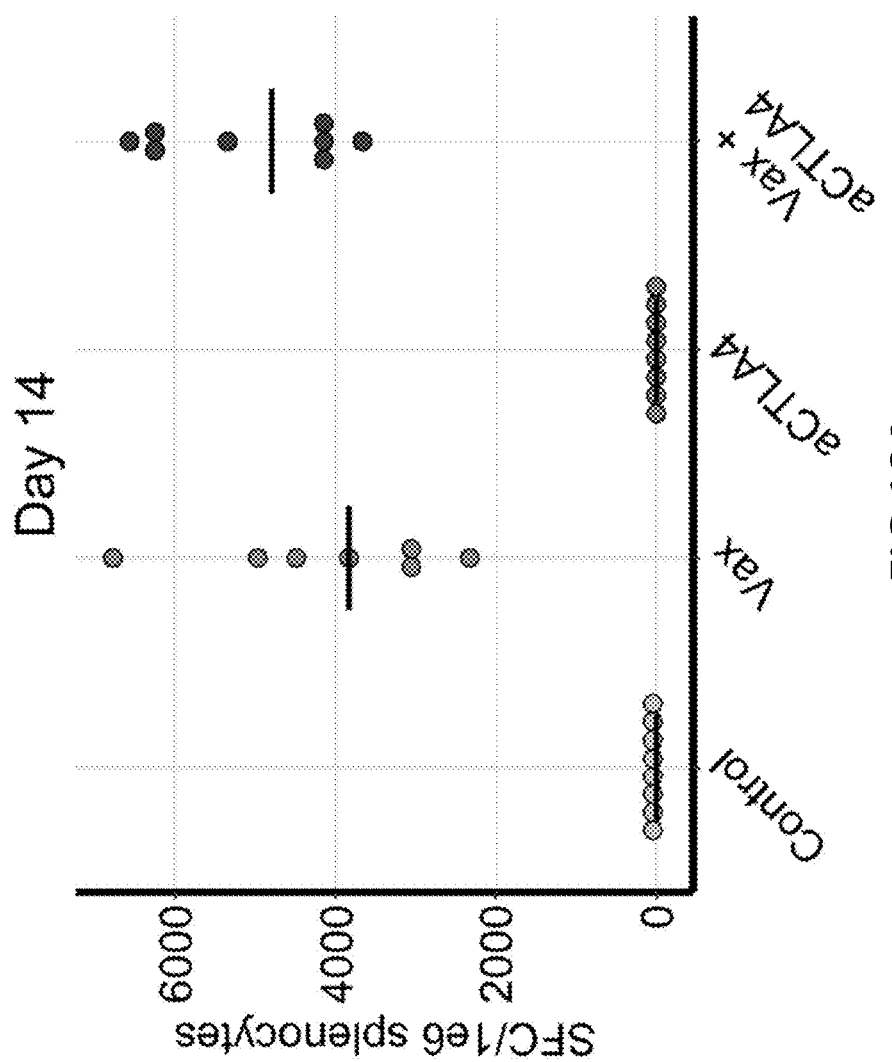

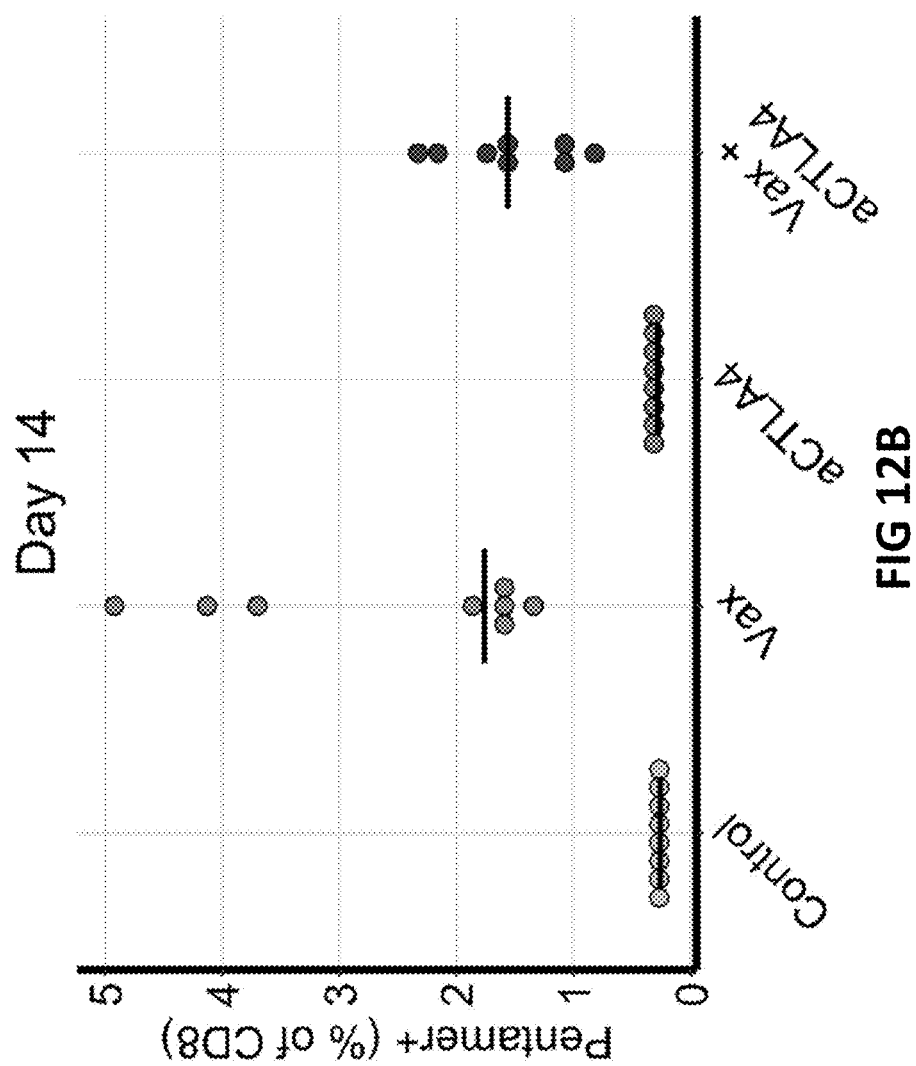

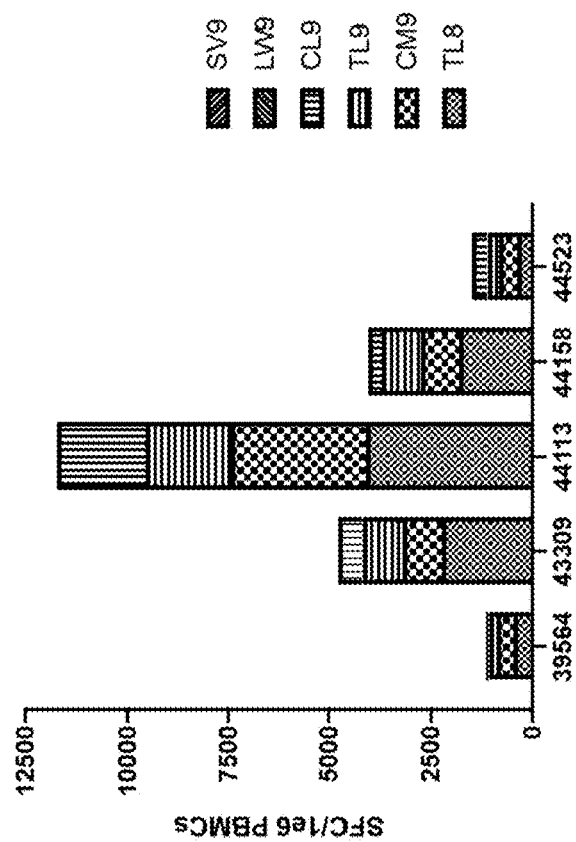
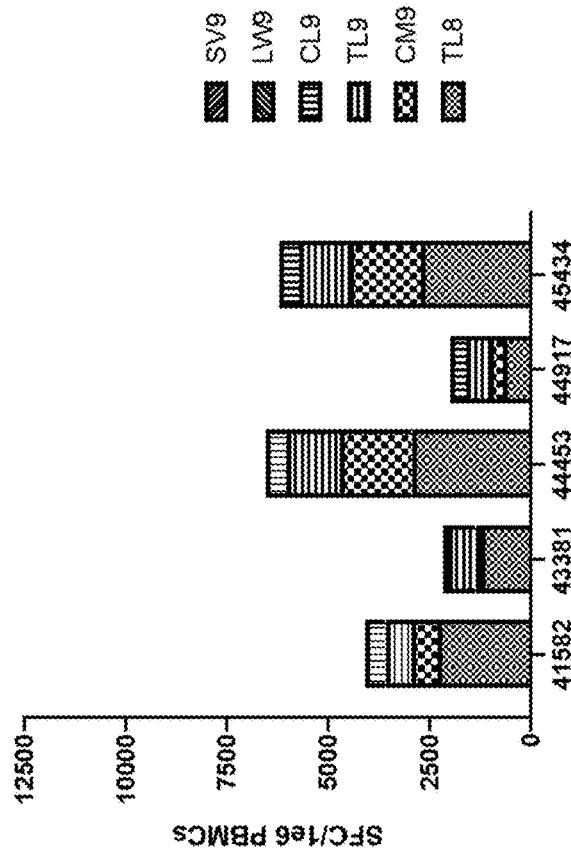
FIG 42B

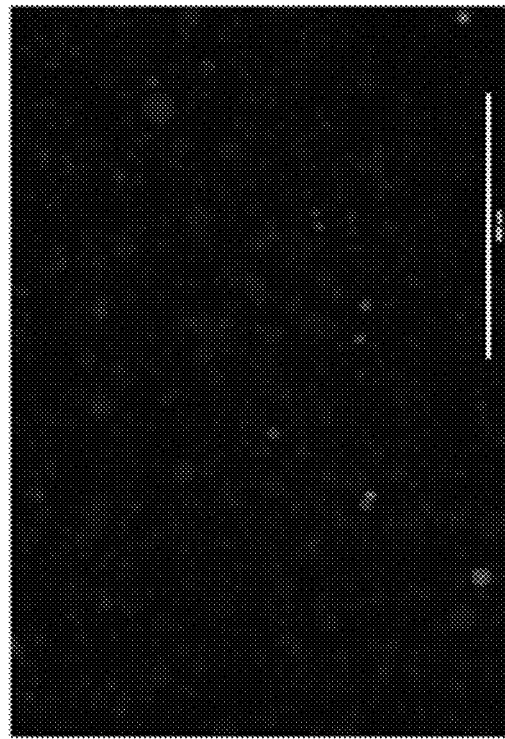
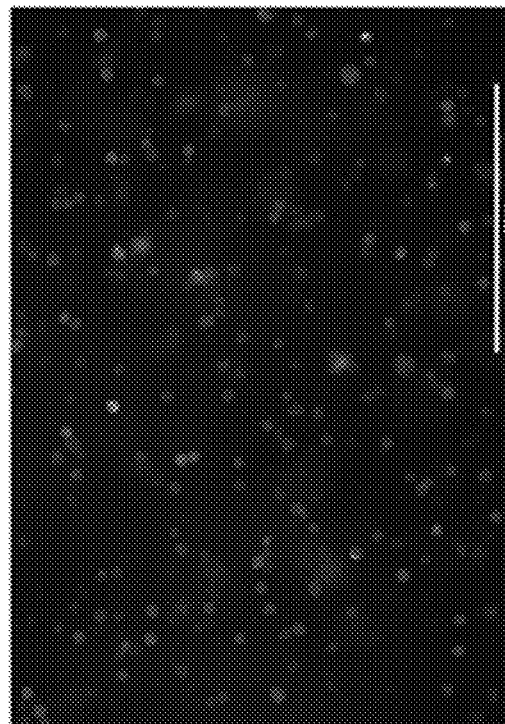
ChAdV68-TETo-GFP
FIG 45A

MODIFIED ADENOVIRUSES

CROSS REFERENCE TO RELATED APPLICATIONS

This application is a continuation U.S. application Ser. No. 17/538,716 filed Nov. 30, 2021, which is continuation of International Application No. PCT/US2020/035591 filed Jun. 1, 2020, which application claims the benefit of U.S. Provisional Application No. 62/854,865 filed May 30, 2019, each of which is hereby incorporated by reference in its entirety for all purposes.

SEQUENCE LISTING

The instant application contains a Sequence Listing which has been submitted electronically in XML format and is hereby incorporated by reference in its entirety. Said XML copy, created on Jan. 26, 2023, is named GSO-033C2.xml and is 800,821 bytes in size.

BACKGROUND

Therapeutic vaccines based on tumor-specific antigens hold great promise as a next-generation of personalized cancer immunotherapy.[1-3] For example, cancers with a high mutational burden, such as non-small cell lung cancer (NSCLC) and melanoma, are particularly attractive targets of such therapy given the relatively greater likelihood of neoantigen generation.[4,5] Early evidence shows that neoantigen-based vaccination can elicit T-cell responses[6] and that neoantigen targeted cell-therapy can cause tumor regression under certain circumstances in selected patients.[7]

One question for antigen vaccine design in both cancer and infectious disease settings is which of the many coding mutations present generate the "best" therapeutic antigens, e.g., antigens that can elicit immunity.

In addition to the challenges of current antigen prediction methods certain challenges also exist with the available vector systems that can be used for antigen delivery in humans, many of which are derived from humans. For example, many humans have pre-existing immunity to human viruses as a result of previous natural exposure, and this immunity can be a major obstacle to the use of recombinant human viruses for antigen delivery in vaccination strategies, such as in cancer treatment or vaccinations against infectious diseases. While some progress has been made in vaccinations strategies addressing the above problems, improvements are still needed, particularly for clinical applications, such as improved vaccine potency and efficacy.

SUMMARY

An adenovirus vector comprising: an adenoviral backbone comprising one or more genes or regulatory sequences of an adenovirus genome, and wherein the adenoviral backbone comprises a partially deleted E4 gene with reference to the adenovirus genome, wherein the partially deleted E4 gene comprises a deleted or partially-deleted E4orf2 region and a deleted or partially-deleted E4orf3 region, and optionally a deleted or partially-deleted E4orf4 region, and optionally, wherein the adenovirus vector further comprises a cassette, the cassette comprising: (1) at least one payload nucleic acid sequence, optionally wherein the at least one payload nucleic acid sequence encodes a polypeptide, optionally wherein the polypeptide comprises an antigen, optionally wherein the antigen comprises: a MHC class I epitope, a MHC class II epitope, an epitope capable of stimulating a B cell response, or a combination thereof, and optionally wherein the at least one payload nucleic acid sequence further comprises a 5' linker sequence and/or a 3' linker sequence, and optionally wherein; (2) at least one promoter sequence operably linked to the at least one payload nucleic acid sequence, (3) optionally, at least one universal MHC class II antigen-encoding nucleic acid sequence; (4) optionally, at least one GPGPG-encoding linker sequence (SEQ ID NO:56); and (5) optionally, at least one polyadenylation sequence.

Also disclosed herein is a chimpanzee adenovirus vector comprising a modified ChAdV68 sequence, wherein the modified ChAdV68 sequence comprises: (a) a partially deleted E4 gene of the E4 gene sequence shown in SEQ ID NO:1 and that lacks at least nucleotides 34,916 to 35,642 of the sequence shown in SEQ ID NO:1; and (b) one or more genes or regulatory sequences of the ChAdV68 sequence shown in SEQ ID NO: 1, optionally wherein the one or more genes or regulatory sequences comprise at least one of the chimpanzee adenovirus inverted terminal repeat (ITR), E1A, E1B, E2A, E2B, E3, E4, L1, L2, L3, L4, and L5 genes of the sequence shown in SEQ ID NO: 1; and optionally, wherein the chimpanzee adenovirus vector further comprises a cassette, wherein the cassette comprises at least one payload nucleic acid sequence, and wherein the cassette comprises at least one promoter sequence operably linked to the at least one payload nucleic acid sequence.

Also disclosed herein is a chimpanzee adenovirus vector comprising a modified ChAdV68 sequence, wherein the modified ChAdV68 sequence comprises: (a) a partially deleted E4 gene of the E4 gene sequence shown in SEQ ID NO:1 and that lacks at least nucleotides 34,916 to 35,642 of the sequence shown in SEQ ID NO:1; (b) nucleotides 2 to 34,916 of the sequence shown in SEQ ID NO:1, wherein the partially deleted E4 gene is 3' of the nucleotides 2 to 34,916, and optionally the nucleotides 2 to 34,916 additionally lack nucleotides 577 to 3403 of the sequence shown in SEQ ID NO:1 corresponding to an E1 deletion and/or lack nucleotides 27,125 to 31,825 of the sequence shown in SEQ ID NO:1 corresponding to an E3 deletion; and (c) nucleotides 35,643 to 36,518 of the sequence shown in SEQ ID NO:1, and wherein the partially deleted E4 gene is 5' of the nucleotides 35,643 to 36,518, and optionally, wherein the chimpanzee adenovirus vector further comprises a cassette, wherein the cassette comprises at least one payload nucleic acid sequence, and wherein the cassette comprises at least one promoter sequence operably linked to the at least one payload nucleic acid sequence.

Also disclosed herein is a chimpanzee adenovirus vector comprising: a. a modified ChAdV68 sequence, wherein the modified ChAdV68 sequence comprises: (i) a partially deleted E4 gene of the E4 gene sequence shown in SEQ ID NO:1 and that lacks at least nucleotides 34,916 to 35,642 of the sequence shown in SEQ ID NO:1; (ii) nucleotides 2 to 34,916 of the sequence shown in SEQ ID NO:1, wherein the partially deleted E4 gene is 3' of the nucleotides 2 to 34,916, and optionally the nucleotides 2 to 34,916 additionally lack nucleotides 577 to 3403 of the sequence shown in SEQ ID NO:1 corresponding to an E1 deletion and/or lack nucleotides 27,125 to 31,825 of the sequence shown in SEQ ID NO:1 corresponding to an E3 deletion; and (iii) and nucleotides 35,643 to 36,518 of the sequence shown in SEQ ID NO:1, and wherein the partially deleted E4 gene is 5' of the nucleotides 35,643 to 36,518, and; b. a CMV-derived promoter sequence; c. an SV40 polyadenylation signal nucleotide sequence; and d. a cassette, the cassette comprising at least one at least one payload nucleic acid sequence encoding: at least one MHC class I epitope, optionally wherein the at least one MHC class I epitope comprises at least 2 distinct MHC class I epitopes linearly linked to each other and each optionally comprising: (A) at least one alteration that makes the encoded peptide sequence distinct from the corresponding peptide sequence encoded by a wild-type nucleic acid sequence, wherein the distinct MHC I epitope is 7-15 amino acids in length, (B) an N-terminal linker comprising a native N-terminal amino acid sequence of the distinct MHC I epitope that is at least 3 amino acids in length, (C) an C-terminal linker comprising a native C-terminal acid sequence of the distinct MHC I epitope that is at least 3 amino acids in length, or (D) combinations thereof, at least one MHC class II epitope, optionally wherein the at least one MHC class II epitope comprises at least 2 distinct MHC class II epitopes, at least one an epitope capable of stimulating a B cell response, or combinations thereof, and wherein the cassette is inserted within a deleted region of ChAdV68 and the CMV-derived promoter sequence is operably linked to the cassette.

Also disclosed herein is a method for stimulating an immune response in a subject, the method comprising administering to the subject an adenovirus vector comprising: an adenoviral backbone comprising one or more genes or regulatory sequences of an adenovirus genome, and wherein the adenoviral backbone comprises a partially deleted E4 gene with reference to the adenovirus genome, wherein the partially deleted E4 gene comprises a deleted or partially-deleted E4orf2 region and a deleted or partially-deleted E4orf3 region, and optionally a deleted or partially-deleted E4orf4 region, and wherein the adenovirus vector further comprises a cassette, the cassette comprising: (1) at least one payload nucleic acid sequence, optionally wherein the at least one payload nucleic acid sequence encodes a polypeptide, optionally wherein the polypeptide comprises an antigen, optionally wherein the antigen comprises: a MHC class I epitope, a MHC class II epitope, an epitope capable of stimulating a B cell response, or a combination thereof, and optionally wherein the at least one payload nucleic acid sequence further comprises a 5' linker sequence and/or a 3' linker sequence, and optionally wherein; (2) at least one promoter sequence operably linked to the at least one payload nucleic acid sequence, (3) optionally, at least one universal MHC class II antigen-encoding nucleic acid sequence; (4) optionally, at least one GPGPG-encoding linker sequence (SEQ ID NO:56); and (5) optionally, at least one polyadenylation sequence.

Also disclosed herein is a method for treating a subject with a disease, optionally wherein the disease is cancer or an infection, the method comprising administering to the subject an adenovirus vector comprising: an adenoviral backbone comprising one or more genes or regulatory sequences of an adenovirus genome, and wherein the adenoviral backbone comprises a partially deleted E4 gene with reference to the adenovirus genome, wherein the partially deleted E4 gene comprises a deleted or partially-deleted E4orf2 region and a deleted or partially-deleted E4orf3 region, and optionally a deleted or partially-deleted E4orf4 region, and wherein the adenovirus vector further comprises a cassette, the cassette comprising: (1) at least one payload nucleic acid sequence, optionally wherein the at least one payload nucleic acid sequence encodes a polypeptide, optionally wherein the polypeptide comprises an antigen, optionally wherein the antigen comprises: a MHC class I epitope, a MHC class II epitope, an epitope capable of stimulating a B cell response, or a combination thereof, and optionally wherein the at least one payload nucleic acid sequence further comprises a 5' linker sequence and/or a 3' linker sequence, and optionally wherein; (2) at least one promoter sequence operably linked to the at least one payload nucleic acid sequence, (3) optionally, at least one universal MHC class II antigen-encoding nucleic acid sequence; (4) optionally, at least one GPGPG-encoding linker sequence (SEQ ID NO:56); and (5) optionally, at least one polyadenylation sequence.

Also disclosed herein is a method for stimulating an immune response in a subject, the method comprising administering to the subject an adenovirus vector comprising a modified ChAdV68 sequence, wherein the modified ChAdV68 sequence comprises: (a) a partially deleted E4 gene of the E4 gene sequence shown in SEQ ID NO:1 and that lacks at least nucleotides 34,916 to 35,642 of the sequence shown in SEQ ID NO:1; and (b) one or more genes or regulatory sequences of the ChAdV68 sequence shown in SEQ ID NO: 1, optionally wherein the one or more genes or regulatory sequences comprise at least one of the chimpanzee adenovirus inverted terminal repeat (ITR), E1A, E1B, E2A, E2B, E3, E4, L1, L2, L3, L4, and L5 genes of the sequence shown in SEQ ID NO: 1; and wherein the chimpanzee adenovirus vector further comprises a cassette, wherein the cassette comprises at least one payload nucleic acid sequence, and wherein the cassette comprises at least one promoter sequence operably linked to the at least one payload nucleic acid sequence.

Also disclosed herein is a method for treating a subject with a disease, optionally wherein the disease is cancer or an infection, the method comprising administering to the subject an adenovirus vector comprising a modified ChAdV68 sequence, wherein the modified ChAdV68 sequence comprises: (a) a partially deleted E4 gene of the E4 gene sequence shown in SEQ ID NO:1 and that lacks at least nucleotides 34,916 to 35,642 of the sequence shown in SEQ ID NO:1; and (b) one or more genes or regulatory sequences of the ChAdV68 sequence shown in SEQ ID NO: 1, optionally wherein the one or more genes or regulatory sequences comprise at least one of the chimpanzee adenovirus inverted terminal repeat (ITR), E1A, E1B, E2A, E2B, E3, E4, L1, L2, L3, L4, and L5 genes of the sequence shown in SEQ ID NO: 1; and wherein the chimpanzee adenovirus vector further comprises a cassette, wherein the cassette comprises at least one payload nucleic acid sequence, and wherein the cassette comprises at least one promoter sequence operably linked to the at least one payload nucleic acid sequence.

Also disclosed herein is a method of producing a virus, wherein the method comprises the steps of: a. providing a viral vector comprising a cassette, the cassette comprising: (i) at least one payload nucleic acid sequence, optionally wherein the at least one payload nucleic acid sequence encodes a polypeptide, optionally wherein the polypeptide comprises an antigen, optionally wherein the antigen comprises: a MHC class I epitope, a MHC class II epitope, an epitope capable of stimulating a B cell response, or a combination thereof, and optionally wherein the at least one payload nucleic acid sequence further comprises a 5' linker sequence and/or a 3' linker sequence, and optionally wherein; (ii) at least one promoter sequence operably linked to the at least one payload nucleic acid sequence, wherein the at least one promoter is a tetracycline (TET) repressor protein (TETr) controlled promoter, (iii) optionally, at least one MHC class II antigen-encoding nucleic acid sequence; (iv) optionally, at least one GPGPG-encoding linker sequence (SEQ ID NO:56); and (v) optionally, at least one polyadenylation sequence; b. providing a cell engineered to express the TETr protein; and c. contacting the viral vector with the cell under conditions sufficient for production of the virus.

In some aspects, the viral vector comprises a chimpanzee adenovirus vector, optionally wherein the chimpanzee adenovirus vector is a ChAdV68 vector. In some aspects, the production of the virus is increased using the vector comprising the TETr controlled promoter relative to production of a virus produced using a vector without the TETr controlled promoter. In some aspects, the increased production is increased at least 1.5-fold, at least 2-fold, at least 2.5-fold, at least 4-fold, at least 5-fold, at least 6-fold, at least 7-fold, at least 8-fold, at least 9-fold, or at least 10-fold relative to production using a vector without the TETr controlled promoter. In some aspects, the increased production is increased at least 15-fold, at least 20-fold, at least 25-fold, at least 30-fold, at least 35-fold, at least 40-fold, at least 50-fold, at least 60-fold, at least 70-fold, at least 80-fold, at least 90-fold, or at least 100-fold relative to production using a vector without the TETr controlled promoter. In some aspects, the production of the virus is increased using the vector comprising the TETr controlled promoter relative to production of a virus produced using a cell that is not engineered to express the TETr protein. In some aspects, the increased production is increased at least 1.5-fold, at least 2-fold, at least 2.5-fold, at least 4-fold, at least 5-fold, at least 6-fold, at least 7-fold, at least 8-fold, at least 9-fold, or at least 10-fold relative to production using a cell that is not engineered to express the TETr protein.

Also provided herein is a viral vector comprising a cassette, the cassette comprising: (i) at least one payload nucleic acid sequence, optionally wherein the at least one payload nucleic acid sequence encodes a polypeptide, optionally wherein the polypeptide comprises an antigen, optionally wherein the antigen comprises: a MHC class I epitope, a MHC class II epitope, an epitope capable of stimulating a B cell response, or a combination thereof, and optionally wherein the at least one payload nucleic acid sequence further comprises a 5' linker sequence and/or a 3' linker sequence, and optionally wherein; (ii) at least one promoter sequence operably linked to the at least one payload nucleic acid sequence, wherein the at least one promoter is a tetracycline (TET) repressor protein (TETr) controlled promoter, (iii) optionally, at least one MHC class II antigen-encoding nucleic acid sequence; (iv) optionally, at least one GPGPG-encoding linker sequence (SEQ ID NO:56); and (v) optionally, at least one polyadenylation sequence.

In some aspects, the TETr controlled promoter comprises one or more TET operator (TETo) nucleic acid sequences, optionally wherein the one or more TETo nucleic acid sequences comprises the nucleotide sequence shown in SEQ ID NO:60. In some aspects, the one or more TETo nucleic acid sequences comprises 2, 3, 4, 5, 6, 7, 8, 9, or 10 or more TETo nucleic acid sequences, optionally wherein each of TETo nucleic acid sequences comprises the nucleotide sequence shown in SEQ ID NO:60. In some aspects, the 2 or more TETo nucleic acid sequences are linked together. In some aspects, the 2 or more TETo nucleic acid sequences are directly linked together. In some aspects, the 2 or more TETo nucleic acid sequences are linked together with a linker sequence, wherein the linker comprises 1, 2, 3, 4, 5, 6, 7, 8, 9, 10, 11, 12, 13, 14, 15, 16, 17, 18, 19, or 20 or more nucleotides, and optionally wherein the linker sequence comprises the linker nucleotide sequence shown in SEQ ID NO:61. In some aspects, the one or more TETo nucleic acid sequences are 5' of a RNA polymerase binding sequence of the promoter sequence. In some aspects, the one or more TETo nucleic acid sequences are 3' of a RNA polymerase binding sequence of the promoter sequence. In some aspects, the at least one promoter sequence comprises a CMV, SV40, EF-1, RSV, PGK, HSA, MCK or EBV promoter sequence. In some aspects, the at least one promoter sequence is a CMV-derived promoter sequence, optionally wherein the CMV promoter sequence comprises the CMV promoter nucleotide sequence shown in SEQ ID NO:64. In some aspects, the CMV-derived promoter sequence is a minimal CMV promoter sequence, optionally wherein the minimal CMV promoter sequence comprises the minimal CMV promoter nucleotide sequence as shown in SEQ ID NO:61.

In some aspects, the TETr controlled promoter operably linked to the at least one payload nucleic acid sequence comprises an ordered sequence described in the formula, from 5' to 3', comprising: $(T-L_Y)_X$-P—N wherein, N comprises one of the at least one payload nucleic acid sequences, optionally wherein each N encodes a MHC class I epitope, a MHC class II epitope, an epitope capable of stimulating a B cell response, or a combination thereof, optionally with at least one alteration that makes the encoded epitope sequence distinct from the corresponding peptide sequence encoded by a wild-type nucleic acid sequence P a RNA polymerase binding sequence of the promoter sequence operably linked to at least one of the at least one payload nucleic acid sequences, T comprises a TETo nucleic acid sequences comprising the nucleotide sequence shown in SEQ ID NO:60, L comprises a linker sequence, where Y=0 or 1 for each X, and wherein X=1, 2, 3, 4, 5, 6, 7, 8, 9, 10, 11, 12, 13, 14, 15, 16, 17, 18, 19, or 20. In some aspects, the TETr controlled promoter operably linked to the at least one payload nucleic acid sequence comprises an ordered sequence described in the formula, from 5' to 3', comprising: P-$(T-L_Y)_X$-N wherein, N comprises one of the at least one payload nucleic acid sequences, optionally wherein each N encodes a MHC class I epitope, a MHC class II epitope, an epitope capable of stimulating a B cell response, or a combination thereof, optionally with at least one alteration that makes the encoded epitope sequence distinct from the corresponding peptide sequence encoded by a wild-type nucleic acid sequence P a RNA polymerase binding sequence of the promoter sequence operably linked to at least one of the at least one payload nucleic acid sequences, T comprises a TETo nucleic acid sequences comprising the nucleotide sequence shown in SEQ ID NO:60, L comprises a linker sequence, where Y=0 or 1 for each X, and wherein X=1, 2, 3, 4, 5, 6, 7, 8, 9, 10, 11, 12, 13, 14, 15, 16, 17, 18, 19, or 20.

In some aspects, the TETr controlled promoter comprises: (1) a minimal CMV promoter sequence; (2) 7 TETo nucleic acid sequences, wherein each of TETo nucleic acid sequences comprises the nucleotide sequence shown in SEQ ID NO:60, and wherein each of the TETo nucleic acid sequences are linked together with a linker sequence, the 7 TETo nucleic acid sequences are 5' of the minimal CMV promoter sequence, and optionally wherein the TETr controlled promoter comprises the nucleotide sequence as shown in SEQ ID NO:61. In some aspects, the TETr controlled promoter comprises: (1) a CMV promoter sequence; (2) 2 TETo nucleic acid sequences, wherein each of the TETo nucleic acid sequences comprises the nucleotide sequence shown in SEQ ID NO:60, and wherein each of the TETo nucleic acid sequences are directly linked together, the 2 TETo nucleic acid sequences are 3' of the CMV promoter sequence, and optionally wherein the TETr controlled promoter comprises the nucleotide sequence as shown in SEQ ID NO:64.

In some aspects, the viral vector comprises a vector backbone, wherein the vector backbone comprises a chimpanzee adenovirus vector, optionally wherein the chimpanzee adenovirus vector is a ChAdV68 vector.

In some aspects, the cassette comprises an ordered sequence described in the formula, from 5' to 3', comprising: $P_a\text{-}(L5_b\text{-}N_c\text{-}L3_d)_X\text{-}(G5_e\text{-}U_f)_Y\text{-}G3_g\text{-}A_h$, wherein, N comprises one of the at least one payload nucleic acid sequences, optionally wherein each N encodes a MHC class I epitope, a MHC class II epitope, an epitope capable of stimulating a B cell response, or a combination thereof, optionally with at least one alteration that makes the encoded epitope sequence distinct from the corresponding peptide sequence encoded by a wild-type nucleic acid sequence, where c=1, P comprises the at least one promoter sequence operably linked to at least one of the at least one payload nucleic acid sequences, where a=1, L5 comprises the 5' linker sequence, where b=0 or 1, L3 comprises the 3' linker sequence, where d=0 or 1, G5 comprises one of the at least one nucleic acid sequences encoding a GPGPG amino acid linker (SEQ ID NO: 56), where e=0 or 1, G3 comprises one of the at least one nucleic acid sequences encoding a GPGPG amino acid linker (SEQ ID NO: 56), where g=0 or 1, U comprises one of the at least one universal MHC class II antigen-encoding nucleic acid sequence, where f=1, A comprises the at least one polyadenylation sequence, where h=0 or 1, X=2 to 400, where for each X the corresponding $N_c$ is a payload nucleic acid sequence, optionally wherein for each X the corresponding $N_c$ is a distinct payload nucleic acid sequence, and Y=0-2, where for each Y the corresponding $U_f$ is a universal MHC class II antigen-encoding nucleic acid sequence, optionally wherein for each Y the corresponding $U_f$ is a distinct universal MHC class II antigen-encoding nucleic acid sequence.

In some aspects, the cassette further comprises at least one additional payload nucleic acid sequence not encoded in the ordered sequence. In some aspects, b=1, d=1, e=1, g=1, h=1, X=10, Y=2, P is a CMV-derived promoter sequence, each N encodes a MHC class I epitope, a MHC class II epitope, an epitope capable of stimulating a B cell response, or a combination thereof, L5 encodes a native N-terminal amino acid sequence of the epitope, and wherein the 5' linker sequence encodes a peptide that is at least 3 amino acids in length, L3 encodes a native C-terminal amino acid sequence of the epitope, and wherein the 3' linker sequence encodes a peptide that is at least 3 amino acids in length, U is each of a PADRE class II sequence and a Tetanus toxoid MHC class II sequence, and the vector comprises a modified ChAdV68 sequence, wherein the modified ChAdV68 sequence comprises: (a) a partially deleted E4 gene of the E4 gene sequence shown in SEQ ID NO:1 and that lacks at least nucleotides 34,916 to 35,642 of the sequence shown in SEQ ID NO:1; (b) nucleotides 2 to 34,916 of the sequence shown in SEQ ID NO:1, wherein the partially deleted E4 gene is 3' of the nucleotides 2 to 34,916, and optionally the nucleotides 2 to 34,916 additionally lack nucleotides 577 to 3403 of the sequence shown in SEQ ID NO:1 corresponding to an E1 deletion and/or lack nucleotides 27,125 to 31,825 of the sequence shown in SEQ ID NO:1 corresponding to an E3 deletion; and (c) nucleotides 35,643 to 36,518 of the sequence shown in SEQ ID NO:1, and wherein the partially deleted E4 gene is 5' of the nucleotides 35,643 to 36,518.

In some aspects, the vector is a chimpanzee adenovirus vector, optionally wherein the chimpanzee adenovirus vector is a ChAdV68 vector.

In some aspects, the partially deleted E4 gene comprises: A. the E4 gene sequence shown in SEQ ID NO:1 and that lacks at least nucleotides 34,916 to 35,642 of the sequence shown in SEQ ID NO:1, B. the E4 gene sequence shown in SEQ ID NO:1 and that lacks at least nucleotides 34,916 to 34,942, nucleotides 34,952 to 35,305 of the sequence shown in SEQ ID NO:1, nucleotides 35,302 to 35,642 of the sequence shown in SEQ ID NO:1, and wherein the vector comprises at least nucleotides 2 to 36,518 of the sequence shown in SEQ ID NO:1, C. the E4 gene sequence shown in SEQ ID NO:1 and that lacks at least nucleotides 34,980 to 36,516 of the sequence shown in SEQ ID NO:1, and wherein the vector comprises at least nucleotides 2 to 36,518 of the sequence shown in SEQ ID NO:1, D. the E4 gene sequence shown in SEQ ID NO:1 and that lacks at least nucleotides 34,979 to 35,642 of the sequence shown in SEQ ID NO:1, and wherein the vector comprises at least nucleotides 2 to 36,518 of the sequence shown in SEQ ID NO:1, E. an E4 deletion of at least a partial deletion of E4Orf2, a fully deleted E4Orf3, and at least a partial deletion of E4Orf4, F. an E4 deletion of at least a partial deletion of E4Orf2, at least a partial deletion of E4Orf3, and at least a partial deletion of E4Orf4, G. an E4 deletion of at least a partial deletion of E4Orf1, a fully deleted E4Orf2, and at least a partial deletion of E4Orf3, or H. an E4 deletion of at least a partial deletion of E4Orf2 and at least a partial deletion of E4Orf3.

In some aspects, the vector comprises one or more genes or regulatory sequences of the ChAdV68 sequence shown in SEQ ID NO: 1, optionally wherein the one or more genes or regulatory sequences are selected from the group consisting of the chimpanzee adenovirus inverted terminal repeat (ITR), E1A, E1B, E2A, E2B, E3, E4, L1, L2, L3, L4, and L5 genes of the sequence shown in SEQ ID NO: 1. In some aspects, the adenoviral backbone or modified ChAdV68 sequence further comprises a functional deletion in at least one gene selected from the group consisting of an adenovirus E1A, E1B, E2A, E2B, E3, L1, L2, L3, L4, and L5 gene with reference to the adenovirus genome or with reference to the sequence shown in SEQ ID NO: 1, optionally wherein the adenoviral backbone or modified ChAdV68 sequence is fully deleted or functionally deleted in: (1) E1A and E1B; or (2) E1A, E1B, and E3 with reference to the adenovirus genome or with reference to the sequence shown in SEQ ID NO: 1, optionally wherein the E1 gene is functionally deleted through an E1 deletion of at least nucleotides 577 to 3403 with reference to the sequence shown in SEQ ID NO: 1 and optionally wherein the E3 gene is functionally deleted through an E3 deletion of at least nucleotides 27,125 to 31,825 with reference to the sequence shown in SEQ ID NO: 1.

In some aspects, the cassette is present and is inserted in the vector at the E1 region, E3 region, and/or any deleted AdV region that allows incorporation of the cassette.

In some aspects, the vector is generated from one of a first generation, a second generation, or a helper-dependent adenoviral vector.

In some aspects, the modified ChAdV68 sequence comprises nucleotides 2 to 34,916 of the sequence shown in SEQ ID NO:1, wherein the partially deleted E4 gene is 3' of the nucleotides 2 to 34,916. In some aspects, the nucleotides 2 to 34,916 lack nucleotides 577 to 3403 of the sequence shown in SEQ ID NO:1 corresponding to an E1 deletion. In some aspects, the nucleotides 2 to 34,916 lack nucleotides 456-3014 with reference to the sequence shown in SEQ ID NO: 1. In some aspects, the nucleotides 2 to 34,916 lack nucleotides 27,125-31,825 with reference to the sequence shown in SEQ ID NO:1 corresponding to an E3 deletion. In some aspects, the nucleotides 2 to 34,916 lack nucleotides 27,816-31,333 with reference to the sequence shown in SEQ ID NO:1. In some aspects, the nucleotides 2 to 34,916 lack nucleotides 577 to 3403 of the sequence shown in SEQ ID NO:1 corresponding to an E1 deletion and lack nucleotides 27,125 to 31,825 of the sequence shown in SEQ ID NO:1 corresponding to an E3 deletion. In some aspects, the nucleotides 2 to 34,916 further lack nucleotides 3957-10346, nucleotides 21787-23370, nucleotides 33486-36193, or a combination thereof with reference to the sequence shown in SEQ ID NO: 1.

In some aspects, at least one of the at least one payload nucleic acid sequences encodes an antigen, wherein the antigen comprises: a MHC class I epitope, a MHC class II epitope, an epitope capable of stimulating a B cell response, or a combination thereof. In some aspects, at least one of the at least one payload nucleic acid sequences encodes a polypeptide sequence capable of undergoing antigen processing into an epitope, optionally wherein the epitope is known or suspected to be presented by MHC class I on a surface of a cell, optionally wherein the surface of the cell is a tumor cell surface or an infected cell surface.

In some aspects, at least one of the at least one payload nucleic acid sequences encodes a polypeptide sequence or portion thereof that is presented by MHC class I and/or MHC class II on a surface of a cell, optionally wherein the surface of the cell is a tumor cell surface or an infected cell surface. In some aspects, the a tumor cell selected from the group consisting of: lung cancer, melanoma, breast cancer, ovarian cancer, prostate cancer, kidney cancer, gastric cancer, colon cancer, testicular cancer, head and neck cancer, pancreatic cancer, brain cancer, B-cell lymphoma, acute myelogenous leukemia, chronic myelogenous leukemia, chronic lymphocytic leukemia, T cell lymphocytic leukemia, non-small cell lung cancer, and small cell lung cancer, or the infected cell selected from the group consisting of: a pathogen infected cell, a virally infected cell, a bacterially infected cell, an fungally infected cell, and a parasitically infected cell, optionally wherein the virally infected cell is selected from the group consisting of: an HIV infected cell, a Severe acute respiratory syndrome-related coronavirus (SARS) infected cell, a severe acute respiratory syndrome coronavirus 2 (SARS-CoV-2) infected cell, a Ebola infected cell, a Hepatitis B virus (HBV) infected cell, an influenza infected cell, and a Hepatitis C virus (HCV) infected cell.

In some aspects, at least one of the at least one payload nucleic acid sequences encodes a polypeptide sequence or portion thereof comprising an epitope capable of stimulating a B cell response, optionally wherein the polypeptide sequence or portion thereof comprises a full-length protein, a protein domain, a protein subunit, or an antigenic fragment predicted or known to be capable of being bound by an antibody.

In some aspects, at least one of the at least one payload nucleic acid sequences encodes an infectious disease organism peptide selected from the group consisting of: a pathogen-derived peptide, a virus-derived peptide, a bacteria-derived peptide, a fungus-derived peptide, and a parasite-derived peptide. In some aspects, at least one of the at least one payload nucleic acid sequences encodes an epitope with at least one alteration that makes the encoded epitope sequence distinct from the corresponding peptide sequence encoded by a wild-type nucleic acid sequence. In some aspects, at least one of the at least one payload nucleic acid sequences encodes a MHC class I epitope or MHC class II epitope with at least one alteration that makes the encoded peptide sequence distinct from the corresponding peptide sequence encoded by a wild-type nucleic acid sequence, optionally wherein the encoded polypeptide sequence or portion thereof has increased binding affinity to, increased binding stability to, and/or an increased likelihood of presentation on its corresponding MHC allele relative to the translated, corresponding wild-type nucleic acid sequence. In some aspects, the at least one alteration comprises a point mutation, a frameshift mutation, a non-frameshift mutation, a deletion mutation, an insertion mutation, a splice variant, a genomic rearrangement, or a proteasome-generated spliced antigen.

In some aspects, at least one of the at least one payload nucleic acid sequences encodes a full-length protein, a protein domain, or a protein subunit. In some aspects, at least one of the at least one payload nucleic acid sequences encodes an antibody, a cytokine, a chimeric antigen receptor (CAR), a T-cell receptor, and a genome-editing system nuclease.

In some aspects, at least one of the at least one payload nucleic acid sequences comprises a non-coding nucleic acid sequence. In some aspects, the non-coding nucleic acid sequence comprises an RNA interference (RNAi) polynucleotide or genome-editing system polynucleotide.

In some aspects, each of the at least one payload nucleic acid sequences is linked directly to one another. In some aspects, at least one of the at least one payload nucleic acid sequences is linked to a distinct payload nucleic acid sequence with a nucleic acid sequence encoding a linker. In some aspects, the linker links two payload nucleic acid sequences encoding MHC class I epitopes or links a first payload nucleic acid sequence encoding an MHC class I epitope to a second payload nucleic acid sequence encoding an MHC class II epitope or encoding an epitope sequence capable of stimulating a B cell response. In some aspects, the linker is selected from the group consisting of: (1) consecutive glycine residues, at least 2, 3, 4, 5, 6, 7, 8, 9, or 10 residues in length; (2) consecutive alanine residues, at least 2, 3, 4, 5, 6, 7, 8, 9, or 10 residues in length; (3) two arginine residues (RR); (4) alanine, alanine, tyrosine (AAY); (5) a consensus sequence at least 2, 3, 4, 5, 6, 7, 8, 9, or 10 amino acid residues in length that is processed efficiently by a mammalian proteasome; and (6) one or more native sequences flanking the antigen derived from the cognate protein of origin and that is at least 2, 3, 4, 5, 6, 7, 8, 9, 10, 11, 12, 13, 14, 15, 16, 17, 18, 19, 20, or 2-20 amino acid residues in length. In some aspects, the linker links two payload nucleic acid sequences encoding MHC class II epitopes or links a first payload nucleic acid sequence encoding an MHC class II epitope to a second payload nucleic acid sequence encoding an MHC class I epitope or encoding an epitope sequence capable of stimulating a B cell response. In some aspects, the linker comprises the sequence GPGPG (SEQ ID NO: 56).

In some aspects, at least one of the at least one payload nucleic acid sequences is linked, operably or directly, to a separate or contiguous sequence that enhances the expression, stability, cell trafficking, processing and presentation, and/or immunogenicity of the at least one payload nucleic acid sequence, and optionally the expression, stability, cell trafficking, processing and presentation, and/or immunogenicity of the polypeptide encoded by the at least one payload nucleic acid sequence. In some aspects, the separate or contiguous sequence comprises at least one of: a ubiquitin sequence, a ubiquitin sequence modified to increase proteasome targeting, optionally wherein the ubiquitin sequence contains a Gly to Ala substitution at position 76, an immunoglobulin signal sequence, optionally wherein the immunoglobulin signal sequence comprises IgK, a major histocompatibility class I sequence, lysosomal-associated membrane protein (LAMP)-1, human dendritic cell lysosomal-associated membrane protein, and a major histocompatibility class II sequence; optionally wherein the ubiquitin sequence modified to increase proteasome targeting is A76.

In some aspects, the expression of each of the at least one payload nucleic acid sequences is driven by the at least one promoter.

In some aspects, the at least one payload nucleic acid sequence comprises at least 2, 3, 4, 5, 6, 7, 8, 9, or 10 payload nucleic acid sequences. In some aspects, the at least one payload nucleic acid sequence comprises at least 11, 12, 13, 14, 15, 16, 17, 18, 19, 20 or up to 400 payload nucleic acid sequences. In some aspects, the at least one payload nucleic acid sequence comprises at least 2-400 payload nucleic acid sequences and wherein at least one of the at least one payload nucleic acid sequences encodes a MHC class I epitope, a MHC class II epitope, an epitope capable of stimulating a B cell response, or a combination thereof. In some aspects, the at least one payload nucleic acid sequence comprises at least 2-400 payload nucleic acid sequences and wherein, when administered to the subject and translated, at least one of the at least one payload nucleic acid sequences encodes an antigen presented on antigen presenting cells resulting in an immune response targeting the antigen. In some aspects, the at least one payload nucleic acid sequence comprises at least 2-400 MHC class I and/or class II antigen-encoding nucleic acid sequences, wherein, when administered to the subject and translated, at least one of the MHC class I or class II antigens are presented on antigen presenting cells resulting in an immune response targeting at least one of the antigens on a cell surface, and optionally wherein the expression of each of the at least 2-400 MHC class I or class II antigen-encoding nucleic acid sequences is driven by the at least one promoter.

In some aspects, each MHC class I epitope is independently between 8 and 35 amino acids in length, optionally 7-15, 9-17, 9-25, 8, 9, 10, 11, 12, 13, 14, 15, 16, 17, 18, 19, 20, 21, 22, 23, 24, 25, 26, 27, 28, 29, 30, 31, 32, 33, 34 or 35 amino acids in length. In some aspects, the at least one universal MHC class II antigen-encoding nucleic acid sequence is present. In some aspects, the at least one universal MHC class II antigen-encoding nucleic acid sequence is present and comprises at least one universal MHC class II antigen-encoding nucleic acid sequence that comprises at least one alteration that makes the encoded peptide sequence distinct from the corresponding peptide sequence encoded by a wild-type nucleic acid sequence. In some aspects, the at least one universal MHC class II antigen-encoding nucleic acid sequence is 12-20, 12, 13, 14, 15, 16, 17, 18, 19, 20, or 20-40 amino acids in length. In some aspects, the at least one universal MHC class II antigen-encoding nucleic acid sequence is present and wherein the at least one universal sequence comprises at least one of Tetanus toxoid and PADRE.

In some aspects, the at least one promoter sequence is a regulatable promoter, optionally wherein the regulatable promoter is a tetracycline (TET) repressor protein (TETr) controlled promoter, optionally wherein the regulatable promoter comprises multiple TET operator (TETo) sequences 5' or 3' of a RNA polymerase binding sequence of the promoter. multiple TET operator (TETo) sequences are 5' or 3' of a RNA the at least one promoter sequence is constitutive. multiple TET operator (TETo) sequences are 5' or 3' of a RNA the at least one promoter sequence is a CMV, SV40, EF-1, RSV, PGK, HSA, MCK or EBV promoter sequence.

In some aspects, the cassette further comprises at least one poly-adenylation (polyA) sequence operably linked to at least one of the at least one payload nucleic acid sequences, optionally wherein the polyA sequence is located 3' of the at least one payload nucleic acid sequence. In some aspects, the polyA sequence comprises an SV40 or Bovine Growth Hormone (BGH) polyA sequence.

In some aspects, the cassette further comprises at least one of: an intron sequence, a woodchuck hepatitis virus post-transcriptional regulatory element (WPRE) sequence, an internal ribosome entry sequence (IRES) sequence, a nucleotide sequence encoding a 2A self-cleaving peptide sequence, a nucleotide sequence encoding a Furin cleavage site, a nucleotide sequence encoding a TEV cleavage site, or a sequence in the 5' or 3' non-coding region known to enhance the nuclear export, stability, or translation efficiency of mRNA that is operably linked to at least one of the at least one payload nucleic acid sequences.

In some aspects, the cassette comprises a reporter gene, including but not limited to, green fluorescent protein (GFP), a GFP variant, secreted alkaline phosphatase, luciferase, or a luciferase variant.

In some aspects, the vector further comprises one or more payload nucleic acid sequences encoding at least one immune modulator, optionally wherein the at least one immune modulator inhibits an immune checkpoint molecule. In some aspects, the immune modulator is an anti-CTLA4 antibody or an antigen-binding fragment thereof, an anti-PD-1 antibody or an antigen-binding fragment thereof, an anti-PD-L1 antibody or an antigen-binding fragment thereof, an anti-4-1BB antibody or an antigen-binding fragment thereof, or an anti-OX-40 antibody or an antigen-binding fragment thereof. In some aspects, the antibody or antigen-binding fragment thereof is a Fab fragment, a Fab' fragment, a single chain Fv (scFv), a single domain antibody (sdAb) either as single specific or multiple specificities linked together (e.g., camelid antibody domains), or full-length single-chain antibody (e.g., full-length IgG with heavy and light chains linked by a flexible linker). In some aspects, the heavy and light chain sequences of the antibody are a contiguous sequence separated by either a self-cleaving sequence such as 2A, optionally wherein the self-cleaving sequence has a Furin cleavage site sequence 5' of the self-cleaving sequence, or an IRES sequence; or the heavy and light chain sequences of the antibody are linked by a flexible linker such as consecutive glycine residues. In some aspects, the immune modulator is a cytokine. In some aspects, the cytokine is at least one of IL-2, IL-7, IL-12, IL-15, or IL-21 or variants thereof of each.

In some aspects, at least one of the at least one payload nucleic acid sequences are selected by performing the steps of: (a) obtaining at least one of exome, transcriptome, or whole genome nucleotide sequencing data from a tumor cell, an infected cell, or an infectious disease organism, wherein the nucleotide sequencing data is used to obtain data representing peptide sequences of each of a set of antigens; (b) inputting the peptide sequence of each antigen into a presentation model to generate a set of numerical likelihoods that each of the antigens is presented by one or more of the MHC alleles on a cell surface, optionally a tumor cell surface or an infected cell surface, the set of numerical likelihoods having been identified at least based on received mass spectrometry data; and (c) selecting a subset of the set of antigens based on the set of numerical likelihoods to generate a set of selected antigens which are used to generate the at least one payload nucleic acid sequence.

In some aspects, each of the at least one payload nucleic acid sequences are selected by performing the steps of: (a) obtaining at least one of exome, transcriptome, or whole genome nucleotide sequencing data from a tumor cell, an infected cell, or an infectious disease organism, wherein the nucleotide sequencing data is used to obtain data representing peptide sequences of each of a set of antigens; (b) inputting the peptide sequence of each antigen into a presentation model to generate a set of numerical likelihoods that each of the antigens is presented by one or more of the MHC alleles on a cell surface, optionally a tumor cell surface or an infected cell surface, the set of numerical likelihoods having been identified at least based on received mass spectrometry data; and (c) selecting a subset of the set of antigens based on the set of numerical likelihoods to generate a set of selected antigens which are used to generate each of the at least one payload nucleic acid sequences. In some aspects, a number of the set of selected antigens is 2-20. In some aspects, the presentation model represents dependence between: (a) presence of a pair of a particular one of the MHC alleles and a particular amino acid at a particular position of a peptide sequence; and (b) likelihood of presentation on a cell surface, optionally a tumor cell surface or an infected cell surface, by the particular one of the MHC alleles of the pair, of such a peptide sequence comprising the particular amino acid at the particular position. In some aspects, selecting the set of selected antigens comprises selecting antigens that have an increased likelihood of being presented on the cell surface relative to unselected antigens based on the presentation model. In some aspects, selecting the set of selected antigens comprises selecting antigens that have an increased likelihood of being capable of inducing a cell-specific immune response in the subject relative to unselected antigens based on the presentation model. In some aspects, selecting the set of selected antigens comprises selecting antigens that have an increased likelihood of being capable of being presented to naïve T cells by professional antigen presenting cells (APCs) relative to unselected antigens based on the presentation model, optionally wherein the APC is a dendritic cell (DC). In some aspects, selecting the set of selected antigens comprises selecting antigens that have a decreased likelihood of being subject to inhibition via central or peripheral tolerance relative to unselected antigens based on the presentation model. In some aspects, selecting the set of selected antigens comprises selecting antigens that have a decreased likelihood of being capable of inducing an autoimmune response to normal tissue in the subject relative to unselected antigens based on the presentation model. In some aspects, exome or transcriptome nucleotide sequencing data is obtained by performing sequencing on a tumor cell or tissue, an infected cell, or an infectious disease organism. In some aspects, the sequencing is next generation sequencing (NGS) or any massively parallel sequencing approach.

In some aspects, the cassette comprises junctional epitope sequences formed by adjacent sequences in the cassette. In some aspects, at least one or each junctional epitope sequence has an affinity of greater than 500 nM for MHC. In some aspects, each junctional epitope sequence is non-self. In some aspects, the cassette does not encode a non-therapeutic MHC class I or class II epitope, wherein the non-therapeutic epitope is predicted to be displayed on an MHC allele of a subject. In some aspects, the non-therapeutic predicted MHC class I or class II epitope sequence is a junctional epitope sequence formed by adjacent sequences in the cassette. In some aspects, the prediction in based on presentation likelihoods generated by inputting sequences of the non-therapeutic epitopes into a presentation model. In some aspects, an order of the at least one payload nucleic acid sequences in the cassette is determined by a series of steps comprising: i. generating a set of candidate cassette sequences corresponding to different orders of the at least one payload nucleic acid sequences; ii. determining, for each candidate cassette sequence, a presentation score based on presentation of non-therapeutic epitopes in the candidate cassette sequence; and iii. selecting a candidate cassette sequence associated with a presentation score below a predetermined threshold as the cassette sequence.

In some aspects, each of the MHC class I and/or class II epitopes is predicted or validated to be capable of presentation by at least one HLA allele present in at least 5% of a human population. In some aspects, each of the MHC class I and/or class II epitopes is predicted or validated to be capable of presentation by at least one HLA allele, wherein each antigen/HLA pair has an antigen/HLA prevalence of at least 0.01% in a human population. In some aspects, each of the MHC class I and/or class II epitopes is predicted or validated to be capable of presentation by at least one HLA allele, wherein each antigen/HLA pair has an antigen/HLA prevalence of at least 0.1% in a human population. In some aspects, the at least one payload nucleic acid sequence encoding the polypeptide is codon optimized relative to a native nucleic acid sequence directly extracted from a subject tissue or sample.

Also disclosed herein is a pharmaceutical composition comprising any of the vectors described herein and a pharmaceutically acceptable carrier. In some aspects, the composition further comprises an adjuvant. In some aspects, the composition further comprises an immune modulator. In some aspects, the immune modulator is an anti-CTLA4 antibody or an antigen-binding fragment thereof, an anti-PD-1 antibody or an antigen-binding fragment thereof, an anti-PD-L1 antibody or an antigen-binding fragment thereof, an anti-4-1BB antibody or an antigen-binding fragment thereof, or an anti-OX-40 antibody or an antigen-binding fragment thereof.

Also disclosed herein is an isolated nucleotide sequence comprising the cassette of any of the vectors described herein and a gene of the sequence of SEQ ID NO: 1, optionally wherein the gene is selected from the group consisting of the chimpanzee adenovirus ITR, E1A, E1B, E2A, E2B, E3, E4, L1, L2, L3, L4, and L5 genes of the sequence shown in SEQ ID NO: 1, and optionally wherein the nucleotide sequence is cDNA.

Also disclosed herein is an isolated cell comprising any of the isolated nucleotide sequences described herein, optionally wherein the cell is a CHO, HEK293 or variants thereof, 911, HeLa, A549, LP-293, PER.C6, or AE1-2a cell.

Also disclosed is vector comprising any of the isolated nucleotide sequences described herein.

Also disclosed herein is a kit comprising any of the vectors or compositions described herein and instructions for use.

Also disclosed herein is a method for stimulating an immune response in a subject, the method comprising administering to the subject any of the vectors or compositions described herein. In some aspects, the vector or composition is administered intramuscularly (IM), intradermally (ID), or subcutaneously (SC). In some aspects, the method further comprises administering to the subject an immune modulator, optionally wherein the immune modulator is administered before, concurrently with, or after administration of the vector or pharmaceutical composition. In some aspects, the immune modulator is an anti-CTLA4 antibody or an antigen-binding fragment thereof, an anti-PD-1 antibody or an antigen-binding fragment thereof, an anti-PD-L1 antibody or an antigen-binding fragment thereof, an anti-4-1BB antibody or an antigen-binding fragment thereof, or an anti-OX-40 antibody or an antigen-binding fragment thereof. In some aspects, the immune modulator is administered intravenously (IV), intramuscularly (IM), intradermally (ID), or subcutaneously (SC). In some aspects, the subcutaneous administration is near the site of the vector or composition administration or in close proximity to one or more vector or composition draining lymph nodes.

In some aspects, the method further comprises administering to the subject a second vaccine composition. In some aspects, the second vaccine composition is administered prior to the administration of any of the vectors or compositions described herein. In some aspects, the second vaccine composition is administered subsequent to the administration of any of the vectors or compositions described herein. In some aspects, the second vaccine composition is the same as any of the vectors or compositions described herein. In some aspects, the second vaccine composition is different from any of the vectors or compositions described herein. In some aspects, the second vaccine composition comprises a self-amplifying RNA (samRNA) vector encoding at least one payload nucleic acid sequence. In some aspects, the at least one payload nucleic acid sequence encoded by the samRNA vector is the same as at least one of the at least one payload nucleic acid sequence of any of the above vector claims.

Also disclosed herein is a method of manufacturing the vector of any of the above vector claims, the method comprising: obtaining a plasmid sequence comprising the adenovirus vector or chimpanzee adenovirus vector; transfecting the plasmid sequence into one or more host cells; and isolating the vector from the one or more host cells. In some aspects, the isolating comprises: lysing the one or more host cells to obtain a cell lysate comprising the vector; and purifying the vector from the cell lysate and optionally also from media used to culture the one or more host cells. In some aspects, the plasmid sequence is generated using one of the following; DNA recombination or bacterial recombination or full genome DNA synthesis or full genome DNA synthesis with amplification of synthesized DNA in bacterial cells. In some aspects, the one or more host cells are at least one of CHO, HEK293 or variants thereof, 911, HeLa, A549, LP-293, PER.C6, and AE1-2a cells. In some aspects, the purifying the vector from the cell lysate involves one or more of chromatographic separation, centrifugation, virus precipitation, and filtration.

Also provided herein is a method of producing a virus, wherein the virus is produced using any of the vectors described herein. In some aspects, the production of the virus is increased using the vector comprising the partially deleted E4 gene relative to production of a virus produced using a vector without the partially deleted E4 gene. In some aspects, the infectious unit titer of the virus is increased using the vector comprising the partially deleted E4 gene relative to the infectious unit titer of a virus produced using a vector without the partially deleted E4 gene. In some aspects, the increased production is increased at least 1.5-fold, at least 2-fold, at least 2.5-fold, at least 4-fold, at least 5-fold, at least 6-fold, at least 7-fold, at least 8-fold, or at least 9-fold relative to production using a vector without the partially deleted E4 gene. In some aspects, the increased production is increased at least 10-fold, at least 18-fold, at least 20-fold, at least 25-fold, or at least 27-fold, relative to production using a vector without the partially deleted E4 gene.

BRIEF DESCRIPTION OF THE SEVERAL VIEWS OF THE DRAWINGS

These and other features, aspects, and advantages of the present invention will become better understood with regard to the following description, and accompanying drawings, where:

FIG. 2B discloses SEQ ID NOS 78-79, 82, 81, 80, 49 and 194, respectively, in order of appearance.

FIG. 5B illustrates in vivo evaluation of the impact of epitope position in long 21-mer cassettes and shows the sequence information on the T cell epitopes used. FIG. 5B discloses SEQ ID NOS 78-79, 82, 81, 80, 195-197, 83 and 198-209, respectively, in order of appearance.

FIG. 6B illustrates final cassette design for preclinical IND-enabling studies and shows the sequence information for the T cell epitopes used that are presented on class I MHC of non-human primate, mouse and human origin, as well as sequences of 2 universal MHC class II epitopes PADRE and Tetanus toxoid. FIG. 6B discloses SEQ ID NOS 112-117, 80-82, 78-79, 72-73, 142, 210, 146-148, 144-145, 49 and 47, respectively, in order of columns.

FIG. 12A illustrates T-cell responses measured 14 days after immunization with VEE srRNA formulated with MC3 LNP in B16-OVA tumor bearing mice. B16-OVA tumor bearing C57BL/6J mice were injected with 10 ug of VEE-Luciferase srRNA (control), VEE-UbAAY srRNA (Vax), VEE-Luciferase srRNA and anti-CTLA-4 (aCTLA-4) or VEE-UbAAY srRNA and anti-CTLA-4 (Vax+aCTLA-4). In addition, all mice were treated with anti-PD1 mAb starting at day 7. Each group consisted of 8 mice. Mice were sacrificed and spleens and lymph nodes were collected 14 days after immunization. SIINFEKL-specific T-cell ("SIINFEKL" disclosed as SEQ ID NO: 72) responses were assessed by IFN-gamma ELISPOT and are reported as spot-forming cells (SFC) per 106 splenocytes. Lines represent medians.

FIG. 12B illustrates T-cell responses measured 14 days after immunization with VEE srRNA formulated with MC3 LNP in B16-OVA tumor bearing mice. B16-OVA tumor bearing C57BL/6J mice were injected with 10 ug of VEE-Luciferase srRNA (control), VEE-UbAAY srRNA (Vax), VEE-Luciferase srRNA and anti-CTLA-4 (aCTLA-4) or VEE-UbAAY srRNA and anti-CTLA-4 (Vax+aCTLA-4). In addition, all mice were treated with anti-PD1 mAb starting at day 7. Each group consisted of 8 mice. Mice were sacrificed and spleens and lymph nodes were collected 14 days after immunization. SIINFEKL-specific T-cell ("SIINFEKL" disclosed as SEQ ID NO: 72) responses were assessed by MHCI-pentamer staining, reported as pentamer positive cells as a percent of CD8 positive cells. Lines represent medians.

FIG. 24A discloses SEQ ID NO: 77.

FIG. 42B shows T cell responses by assessing IFN-gamma production by ELISpot following stimulation with 6 different rhesus macaque Mamu-A*01 class I epitopes at week 2 in Rhesus macaques were immunized with ChAdV68-CMV-MAG (left panel) and ChAdV68-E4d-CMT-MAG (right panel), and both conditions administered an anti-CTLA4 antibody (Ipilimumab).

FIG. 45A shows TETr mediated regulation of GFP expressed from a ChAdV68 vector with a TETo sequence. GFP is significantly reduced in 293F cells expressing the TETr (Clone 17, right panel) relative to the parental 293F cell line (left panel). Cells were infected at an MOI of 1 with ChAdV68-TETo-GFP and 24 h later GFP was evaluated by florescent microscopy under a 10× objective.

DETAILED DESCRIPTION

I. Definitions

Figure 1:
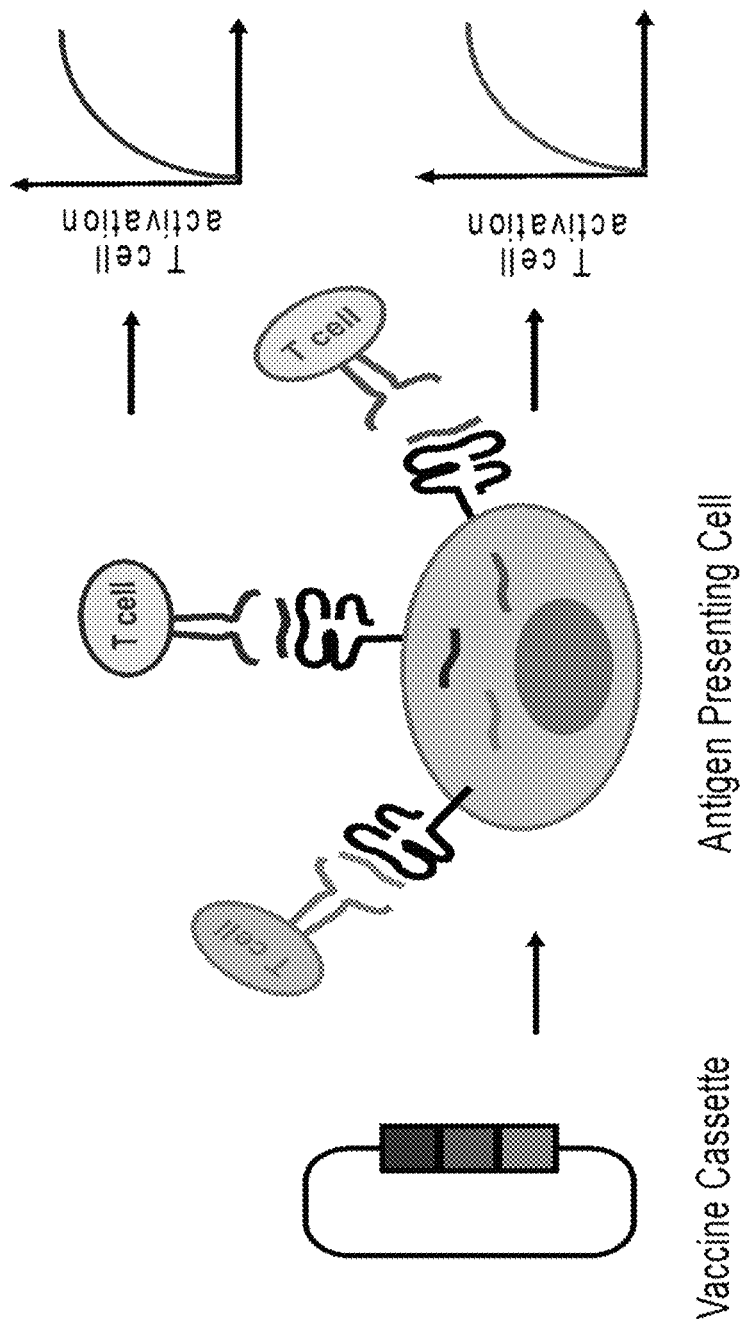
FIG. 1 illustrates development of an in vitro T cell activation assay. Schematic of the assay in which the delivery of a vaccine cassette to antigen presenting cells, leads to expression, processing and MHC-restricted presentation of distinct peptide antigens. Reporter T cells engineered with T cell receptors that match the specific peptide-MHC combination become activated resulting in luciferase expression.

In general, terms used in the claims and the specification are intended to be construed as having the plain meaning understood by a person of ordinary skill in the art. Certain terms are defined below to provide additional clarity. In case of conflict between the plain meaning and the provided definitions, the provided definitions are to be used.

As used herein the term "antigen" is a substance that induces an immune response. An antigen can be a neoantigen. An antigen can be a "shared antigen" that is an antigen found among a specific population, e.g., a specific population of cancer patients or infected subjects. An antigen can be associated with or derived from an infectious disease organism.

As used herein the term "neoantigen" is an antigen that has at least one alteration that makes it distinct from the corresponding wild-type antigen, e.g., via mutation in a tumor cell or post-translational modification specific to a tumor cell. A neoantigen can include a polypeptide sequence or a nucleic acid sequence. A mutation can include a frameshift or nonframeshift indel, missense or nonsense substitution, splice site alteration, genomic rearrangement or gene fusion, or any genomic or expression alteration giving rise to a neoORF. A mutations can also include a splice variant. Post-translational modifications specific to a tumor cell can include aberrant phosphorylation. Post-translational modifications specific to a tumor cell can also include a proteasome-generated spliced antigen. See Liepe et al., A large fraction of HLA class I ligands are proteasome-generated spliced peptides; Science. 2016 Oct. 21; 354 (6310):354-358. The subject can be identified for administration through the use of various diagnostic methods, e.g., patient selection methods described further below.

As used herein the term "tumor antigen" is an antigen present in a subject's tumor cell or tissue but not in the subject's corresponding normal cell or tissue, or derived from a polypeptide known to or have been found to have altered expression in a tumor cell or cancerous tissue in comparison to a normal cell or tissue.

As used herein the term "antigen-based vaccine" is a vaccine composition based on one or more antigens, e.g., a plurality of antigens. The vaccines can be nucleotide-based (e.g., virally based, RNA based, or DNA based), protein-based (e.g., peptide based), or a combination thereof.

As used herein the term "candidate antigen" is a mutation or other aberration giving rise to a sequence that may represent an antigen.

As used herein the term "coding region" is the portion(s) of a gene that encode protein.

As used herein the term "coding mutation" is a mutation occurring in a coding region.

As used herein the term "ORF" means open reading frame.

As used herein the term "NEO-ORF" is a tumor-specific ORF arising from a mutation or other aberration such as splicing.

As used herein the term "missense mutation" is a mutation causing a substitution from one amino acid to another.

As used herein the term "nonsense mutation" is a mutation causing a substitution from an amino acid to a stop codon or causing removal of a canonical start codon.

As used herein the term "frameshift mutation" is a mutation causing a change in the frame of the protein.

As used herein the term "indel" is an insertion or deletion of one or more nucleic acids.

As used herein, the term percent "identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the percent "identity" can exist over a region of the sequence being compared, e.g., over a functional domain, or, alternatively, exist over the full length of the two sequences to be compared.

For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. Alternatively, sequence similarity or dissimilarity can be established by the combined presence or absence of particular nucleotides, or, for translated sequences, amino acids at selected sequence positions (e.g., sequence motifs).

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al.).

One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information.

As used herein the term "non-stop or read-through" is a mutation causing the removal of the natural stop codon.

As used herein the term "epitope" is the specific portion of an antigen typically bound by an antibody or T cell receptor.

As used herein the term "immunogenic" is the ability to elicit an immune response, e.g., via T cells, B cells, or both.

As used herein the term "HLA binding affinity" "MHC binding affinity" means affinity of binding between a specific antigen and a specific MHC allele.

As used herein the term "bait" is a nucleic acid probe used to enrich a specific sequence of DNA or RNA from a sample.

As used herein the term "variant" is a difference between a subject's nucleic acids and the reference human genome used as a control.

As used herein the term "variant call" is an algorithmic determination of the presence of a variant, typically from sequencing.

As used herein the term "polymorphism" is a germline variant, i.e., a variant found in all DNA-bearing cells of an individual.

As used herein the term "somatic variant" is a variant arising in non-germline cells of an individual.

As used herein the term "allele" is a version of a gene or a version of a genetic sequence or a version of a protein.

As used herein the term "HLA type" is the complement of HLA gene alleles.

As used herein the term "nonsense-mediated decay" or "NMD" is a degradation of an mRNA by a cell due to a premature stop codon.

As used herein the term "truncal mutation" is a mutation originating early in the development of a tumor and present in a substantial portion of the tumor's cells.

As used herein the term "subclonal mutation" is a mutation originating later in the development of a tumor and present in only a subset of the tumor's cells.

As used herein the term "exome" is a subset of the genome that codes for proteins. An exome can be the collective exons of a genome.

As used herein the term "logistic regression" is a regression model for binary data from statistics where the logit of the probability that the dependent variable is equal to one is modeled as a linear function of the dependent variables.

As used herein the term "neural network" is a machine learning model for classification or regression consisting of multiple layers of linear transformations followed by element-wise nonlinearities typically trained via stochastic gradient descent and back-propagation.

As used herein the term "proteome" is the set of all proteins expressed and/or translated by a cell, group of cells, or individual.

As used herein the term "peptidome" is the set of all peptides presented by MHC-I or MHC-II on the cell surface. The peptidome may refer to a property of a cell or a collection of cells (e.g., the tumor peptidome, meaning the union of the peptidomes of all cells that comprise the tumor).

As used herein the term "ELISPOT" means Enzyme-linked immunosorbent spot assay—which is a common method for monitoring immune responses in humans and animals.

As used herein the term "dextramers" is a dextran-based peptide-MHC multimers used for antigen-specific T-cell staining in flow cytometry.

As used herein the term "tolerance or immune tolerance" is a state of immune non-responsiveness to one or more antigens, e.g. self-antigens.

As used herein the term "central tolerance" is a tolerance affected in the thymus, either by deleting self-reactive T-cell clones or by promoting self-reactive T-cell clones to differentiate into immunosuppressive regulatory T-cells (Tregs).

As used herein the term "peripheral tolerance" is a tolerance affected in the periphery by downregulating or anergizing self-reactive T-cells that survive central tolerance or promoting these T cells to differentiate into Tregs.

The term "sample" can include a single cell or multiple cells or fragments of cells or an aliquot of body fluid, taken from a subject, by means including venipuncture, excretion, ejaculation, massage, biopsy, needle aspirate, lavage sample, scraping, surgical incision, or intervention or other means known in the art.

The term "subject" encompasses a cell, tissue, or organism, human or non-human, whether in vivo, ex vivo, or in vitro, male or female. The term subject is inclusive of mammals including humans.

The term "mammal" encompasses both humans and non-humans and includes but is not limited to humans, non-human primates, canines, felines, murines, bovines, equines, and porcines.

The term "clinical factor" refers to a measure of a condition of a subject, e.g., disease activity or severity. "Clinical factor" encompasses all markers of a subject's health status, including non-sample markers, and/or other characteristics of a subject, such as, without limitation, age and gender. A clinical factor can be a score, a value, or a set of values that can be obtained from evaluation of a sample (or population of samples) from a subject or a subject under a determined condition. A clinical factor can also be predicted by markers and/or other parameters such as gene expression surrogates. Clinical factors can include tumor type, tumor sub-type, and smoking history.

The term "derived" refers to sequences directly extracted from a subject tissue or sample (e.g., a tumor, cell, infected cell, or infectious disease organism), e.g. via RT-PCR; or sequence data obtained by sequencing the subject tissue or sample and then synthesizing the nucleic acid sequences using the sequencing data, e.g., via various synthetic or PCR-based methods known in the art. "Derived" can include nucleic acid sequence variants, such as codon-optimized nucleic acid sequence variants, that encode the same polypeptide sequence as a corresponding native nucleic acid sequence, such as a corresponding native infectious disease organism nucleic acid sequence. "Derived" can also include variants that encode a modified polypeptide sequence, such as an infectious disease organism polypeptide sequence, having one or more (e.g., 1, 2, 3, 4, or 5) mutations relative to a native polypeptide sequence, such as native infectious disease organism polypeptide sequence. For example, a modified polypeptide sequence can have one or more missense mutations (e.g., engineered mutations) relative to the native polypeptide sequence.

The term "alphavirus" refers to members of the family Togaviridae, and are positive-sense single-stranded RNA viruses. Alphaviruses are typically classified as either Old World, such as Sindbis, Ross River, Mayaro, Chikungunya, and Semliki Forest viruses, or New World, such as eastern equine encephalitis, Aura, Fort Morgan, or Venezuelan equine encephalitis and its derivative strain TC-83. Alphaviruses are typically self-replicating RNA viruses.

The term "alphavirus backbone" refers to minimal sequence(s) of an alphavirus that allow for self-replication of the viral genome. Minimal sequences can include conserved sequences for nonstructural protein-mediated amplification, a nonstructural protein 1 (nsP1) gene, a nsP2 gene, a nsP3 gene, a nsP4 gene, and a polyA sequence, as well as sequences for expression of subgenomic viral RNA including a 26S promoter element.

The term "sequences for nonstructural protein-mediated amplification" includes alphavirus conserved sequence elements (CSE) well known to those in the art. CSEs include, but are not limited to, an alphavirus 5' UTR, a 51-nt CSE, a 24-nt CSE, or other 26S subgenomic promoter sequence, a 19-nt CSE, and an alphavirus 3' UTR.

The term "RNA polymerase" includes polymerases that catalyze the production of RNA polynucleotides from a DNA template. RNA polymerases include, but are not limited to, bacteriophage derived polymerases including T3, T7, and SP6.

The term "lipid" includes hydrophobic and/or amphiphilic molecules. Lipids can be cationic, anionic, or neutral. Lipids can be synthetic or naturally derived, and in some instances biodegradable. Lipids can include cholesterol, phospholipids, lipid conjugates including, but not limited to, polyethyleneglycol (PEG) conjugates (PEGylated lipids), waxes, oils, glycerides, fats, and fat-soluble vitamins. Lipids can also include dilinoleylmethyl-4-dimethylaminobutyrate (MC3) and MC3-like molecules.

The term "lipid nanoparticle" or "LNP" includes vesicle like structures formed using a lipid containing membrane surrounding an aqueous interior, also referred to as liposomes. Lipid nanoparticles includes lipid-based compositions with a solid lipid core stabilized by a surfactant. The core lipids can be fatty acids, acylglycerols, waxes, and mixtures of these surfactants. Biological membrane lipids such as phospholipids, sphingomyelins, bile salts (sodium taurocholate), and sterols (cholesterol) can be utilized as stabilizers. Lipid nanoparticles can be formed using defined ratios of different lipid molecules, including, but not limited to, defined ratios of one or more cationic, anionic, or neutral lipids. Lipid nanoparticles can encapsulate molecules within an outer-membrane shell and subsequently can be contacted with target cells to deliver the encapsulated molecules to the host cell cytosol. Lipid nanoparticles can be modified or functionalized with non-lipid molecules, including on their surface. Lipid nanoparticles can be single-layered (unilamellar) or multi-layered (multilamellar). Lipid nanoparticles can be complexed with nucleic acid. Unilamellar lipid nanoparticles can be complexed with nucleic acid, wherein the nucleic acid is in the aqueous interior. Multilamellar lipid nanoparticles can be complexed with nucleic acid, wherein the nucleic acid is in the aqueous interior, or to form or sandwiched between Abbreviations: MHC: major histocompatibility complex; HLA: human leukocyte antigen, or the human MHC gene locus; NGS: next-generation sequencing; PPV: positive predictive value; TSNA: tumor-specific neoantigen; FFPE: formalin-fixed, paraffin-embedded; NMD: nonsense-mediated decay; NSCLC: non-small-cell lung cancer; DC: dendritic cell.

It should be noted that, as used in the specification and the appended claims, the singular forms "a," "an," and "the" include plural referents unless the context clearly dictates otherwise.

Unless specifically stated or otherwise apparent from context, as used herein the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

Any terms not directly defined herein shall be understood to have the meanings commonly associated with them as understood within the art of the invention. Certain terms are discussed herein to provide additional guidance to the practitioner in describing the compositions, devices, methods and the like of aspects of the invention, and how to make or use them. It will be appreciated that the same thing may be said in more than one way. Consequently, alternative language and synonyms may be used for any one or more of the terms discussed herein. No significance is to be placed upon whether or not a term is elaborated or discussed herein. Some synonyms or substitutable methods, materials and the like are provided. Recital of one or a few synonyms or equivalents does not exclude use of other synonyms or equivalents, unless it is explicitly stated. Use of examples, including examples of terms, is for illustrative purposes only and does not limit the scope and meaning of the aspects of the invention herein.

All references, issued patents and patent applications cited within the body of the specification are hereby incorporated by reference in their entirety, for all purposes.

II. Methods of Identifying Antigens

Methods for identifying antigens (e.g., antigens derived from a tumor or an infectious disease organism) include identifying antigens that are likely to be presented on a cell surface (e.g., presented by MHC on a tumor cell, an infected cell, or an immune cell, including professional antigen presenting cells such as dendritic cells), and/or are likely to be immunogenic. As an example, one such method may comprise the steps of: obtaining at least one of exome, transcriptome or whole genome nucleotide sequencing and/or expression data from a tumor, an infected cell, or an infectious disease organism, wherein the nucleotide sequencing data and/or expression data is used to obtain data representing peptide sequences of each of a set of antigens (e.g., antigens derived from the tumor or infectious disease organism); inputting the peptide sequence of each antigen into one or more presentation models to generate a set of numerical likelihoods that each of the antigens is presented by one or more MHC alleles on a cell surface, such as a tumor cell or an infected cell of the subject, the set of numerical likelihoods having been identified at least based on received mass spectrometry data; and selecting a subset of the set of antigens based on the set of numerical likelihoods to generate a set of selected antigens.

In one example directed to tumor vaccines, and which can be adapted to infectious disease vaccines, the presentation model can comprise a statistical regression or a machine learning (e.g., deep learning) model trained on a set of reference data (also referred to as a training data set) comprising a set of corresponding labels, wherein the set of reference data is obtained from each of a plurality of distinct subjects where optionally some subjects can have a tumor, and wherein the set of reference data comprises at least one of: data representing exome nucleic acid sequences from tumor tissue, data representing exome nucleic acid sequences from normal tissue, data representing transcriptome nucleic acid sequences from tumor tissue, data representing proteome sequences from tumor tissue, and data representing MHC peptidome sequences from tumor tissue, and data representing MHC peptidome sequences from normal tissue. The reference data can further comprise mass spectrometry data, sequencing data, RNA sequencing data, expression profiling data, and proteomics data for single-allele cell lines engineered to express a predetermined MHC allele that are subsequently exposed to synthetic protein, normal and tumor human cell lines, and fresh and frozen primary samples, and T cell assays (e.g., ELISPOT). In certain aspects, the set of reference data includes each form of reference data.

The presentation model can comprise a set of features derived at least in part from the set of reference data, and wherein the set of features comprises at least one of allele dependent-features and allele-independent features. In certain aspects each feature is included.

Methods for identifying antigens also include generating an output for constructing a personalized vaccine by identifying one or more antigens that are likely to be presented on a surface of subject's cells, such as a tumor cell or infected cell. As an example directed to tumor vaccines, and which can be adapted to infectious disease vaccines, one such method may comprise the steps of: obtaining at least one of exome, transcriptome, or whole genome nucleotide sequencing and/or expression data from the tumor cells and normal cells of the subject, wherein the nucleotide sequencing and/or expression data is used to obtain data representing peptide sequences of each of a set of antigens identified by comparing the nucleotide sequencing and/or expression data from the tumor cells and the nucleotide sequencing and/or expression data from the normal cells (e.g., in the case of neoantigens wherein the peptide sequence of each neoantigen comprises at least one alteration that makes it distinct from the corresponding wild-type peptide sequence or in cases of antigens without a mutation where peptides are derived from any polypeptide known to or have been found to have altered expression in a tumor cell or cancerous tissue in comparison to a normal cell or tissue), peptide sequence identified from the normal cells of the subject; encoding the peptide sequences of each of the antigens into a corresponding numerical vector, each numerical vector including information regarding a plurality of amino acids that make up the peptide sequence and a set of positions of the amino acids in the peptide sequence; inputting the numerical vectors, using a computer processor, into a deep learning presentation model to generate a set of presentation likelihoods for the set of antigens, each presentation likelihood in the set representing the likelihood that a corresponding antigen is presented by one or more class II MHC alleles on the surface of the tumor cells of the subject, the deep learning presentation model; selecting a subset of the set of antigens based on the set of presentation likelihoods to generate a set of selected antigens; and generating the output for constructing the personalized cancer vaccine based on the set of selected antigens.

Specific methods for identifying antigens, including neoantigens, are known to those skilled in the art, for example the methods described in more detail in international patent application publications WO/2017/106638, WO/2018/195357, and WO/2018/208856, each herein incorporated by reference, in their entirety, for all purposes.

A method of treating a subject having a tumor is disclosed herein, comprising performing the steps of any of the antigen identification methods described herein, and further comprising obtaining a tumor vaccine comprising the set of selected antigens, and administering the tumor vaccine to the subject.

A method disclosed herein can also include identifying one or more T cells that are antigen-specific for at least one of the antigens in the subset. In some embodiments, the identification comprises co-culturing the one or more T cells with one or more of the antigens in the subset under conditions that expand the one or more antigen-specific T cells. In further embodiments, the identification comprises contacting the one or more T cells with a tetramer comprising one or more of the antigens in the subset under conditions that allow binding between the T cell and the tetramer. In even further embodiments, the method disclosed herein can also include identifying one or more T cell receptors (TCR) of the one or more identified T cells. In certain embodiments, identifying the one or more T cell receptors comprises sequencing the T cell receptor sequences of the one or more identified T cells. The method disclosed herein can further comprise genetically engineering a plurality of T cells to express at least one of the one or more identified T cell receptors; culturing the plurality of T cells under conditions that expand the plurality of T cells; and infusing the expanded T cells into the subject. In some embodiments, genetically engineering the plurality of T cells to express at least one of the one or more identified T cell receptors comprises cloning the T cell receptor sequences of the one or more identified T cells into an expression vector; and transfecting each of the plurality of T cells with the expression vector. In some embodiments, the method disclosed herein further comprises culturing the one or more identified T cells under conditions that expand the one or more identified T cells; and infusing the expanded T cells into the subject.

Also disclosed herein is an isolated T cell that is antigen-specific for at least one selected antigen in the subset.

Also disclosed herein is a methods for manufacturing a tumor vaccine, comprising the steps of: obtaining at least one of exome, transcriptome or whole genome tumor nucleotide sequencing and/or expression data from the tumor cell of the subject, wherein the tumor nucleotide sequencing and/or expression data is used to obtain data representing peptide sequences of each of a set of antigens (e.g., in the case of neoantigens wherein the peptide sequence of each neoantigen comprises at least one alteration that makes it distinct from the corresponding wild-type peptide sequence or in cases of antigens without a mutation where peptides are derived from any polypeptide known to or have been found to have altered expression in a tumor cell or cancerous tissue in comparison to a normal cell or tissue); inputting the peptide sequence of each antigen into one or more presentation models to generate a set of numerical likelihoods that each of the antigens is presented by one or more MHC alleles on the tumor cell surface of the tumor cell of the subject, the set of numerical likelihoods having been identified at least based on received mass spectrometry data; and selecting a subset of the set of antigens based on the set of numerical likelihoods to generate a set of selected antigens; and producing or having produced a tumor vaccine comprising the set of selected antigens.

Also disclosed herein is a tumor vaccine including a set of selected antigens selected by performing the method comprising the steps of: obtaining at least one of exome, transcriptome or whole genome tumor nucleotide sequencing and/or expression data from the tumor cell of the subject, wherein the tumor nucleotide sequencing and/or expression data is used to obtain data representing peptide sequences of each of a set of antigens, and wherein the peptide sequence of each antigen (e.g., in the case of neoantigens wherein the peptide sequence of each neoantigen comprises at least one alteration that makes it distinct from the corresponding wild-type peptide sequence or in other cases of antigens without a mutation where peptides are derived from any polypeptide known to or have been found to have altered expression in a tumor cell or cancerous tissue in comparison to a normal cell or tissue); inputting the peptide sequence of each antigen into one or more presentation models to generate a set of numerical likelihoods that each of the antigens is presented by one or more MHC alleles on the tumor cell surface of the tumor cell of the subject, the set of numerical likelihoods having been identified at least based on received mass spectrometry data; and selecting a subset of the set of antigens based on the set of numerical likelihoods to generate a set of selected antigens; and producing or having produced a tumor vaccine comprising the set of selected antigens.

The tumor vaccine may include one or more of a nucleic acid sequence, a polypeptide sequence, RNA, DNA, a cell, a plasmid, or a vector.

The tumor vaccine may include one or more antigens presented on the tumor cell surface.

The tumor vaccine may include one or more antigens that is immunogenic in the subject.

The tumor vaccine may not include one or more antigens that induce an autoimmune response against normal tissue in the subject.

The tumor vaccine may include an adjuvant.

The tumor vaccine may include an excipient.

A method disclosed herein may also include selecting antigens that have an increased likelihood of being presented on the tumor cell surface relative to unselected antigens based on the presentation model.

A method disclosed herein may also include selecting antigens that have an increased likelihood of being capable of inducing a tumor-specific immune response in the subject relative to unselected antigens based on the presentation model.

A method disclosed herein may also include selecting antigens that have an increased likelihood of being capable of being presented to naïve T cells by professional antigen presenting cells (APCs) relative to unselected antigens based on the presentation model, optionally wherein the APC is a dendritic cell (DC).

A method disclosed herein may also include selecting antigens that have a decreased likelihood of being subject to inhibition via central or peripheral tolerance relative to unselected antigens based on the presentation model.

A method disclosed herein may also include selecting antigens that have a decreased likelihood of being capable of inducing an autoimmune response to normal tissue in the subject relative to unselected antigens based on the presentation model.

The exome or transcriptome nucleotide sequencing and/or expression data may be obtained by performing sequencing on the tumor tissue.

The sequencing may be next generation sequencing (NGS) or any massively parallel sequencing approach.

The set of numerical likelihoods may be further identified by at least MHC-allele interacting features comprising at least one of: the predicted affinity with which the MHC allele and the antigen encoded peptide bind; the predicted stability of the antigen encoded peptide-MHC complex; the sequence and length of the antigen encoded peptide; the probability of presentation of antigen encoded peptides with similar sequence in cells from other individuals expressing the particular MHC allele as assessed by mass-spectrometry proteomics or other means; the expression levels of the particular MHC allele in the subject in question (e.g. as measured by RNA-seq or mass spectrometry); the overall neoantigen encoded peptide-sequence-independent probability of presentation by the particular MHC allele in other distinct subjects who express the particular MHC allele; the overall neoantigen encoded peptide-sequence-independent probability of presentation by MHC alleles in the same family of molecules (e.g., HLA-A, HLA-B, HLA-C, HLA-DQ, HLA-DR, HLA-DP) in other distinct subjects.

The set of numerical likelihoods are further identified by at least MHC-allele noninteracting features comprising at least one of: the C- and N-terminal sequences flanking the neoantigen encoded peptide within its source protein sequence; the presence of protease cleavage motifs in the neoantigen encoded peptide, optionally weighted according to the expression of corresponding proteases in the tumor cells (as measured by RNA-seq or mass spectrometry); the turnover rate of the source protein as measured in the appropriate cell type; the length of the source protein, optionally considering the specific splice variants ("isoforms") most highly expressed in the tumor cells as measured by RNA-seq or proteome mass spectrometry, or as predicted from the annotation of germline or somatic splicing mutations detected in DNA or RNA sequence data; the level of expression of the proteasome, immunoproteasome, thymoproteasome, or other proteases in the tumor cells (which may be measured by RNA-seq, proteome mass spectrometry, or immunohistochemistry); the expression of the source gene of the neoantigen encoded peptide (e.g., as measured by RNA-seq or mass spectrometry); the typical tissue-specific expression of the source gene of the neoantigen encoded peptide during various stages of the cell cycle; a comprehensive catalog of features of the source protein and/or its domains as can be found in e.g. uniProt or PDB world wide web at rcsb.org/pdb/home/home.do; features describing the properties of the domain of the source protein containing the peptide, for example: secondary or tertiary structure (e.g., alpha helix vs beta sheet); alternative splicing; the probability of presentation of peptides from the source protein of the neoantigen encoded peptide in question in other distinct subjects; the probability that the peptide will not be detected or over-represented by mass spectrometry due to technical biases; the expression of various gene modules/pathways as measured by RNASeq (which need not contain the source protein of the peptide) that are informative about the state of the tumor cells, stroma, or tumor-infiltrating lymphocytes (TILs); the copy number of the source gene of the neoantigen encoded peptide in the tumor cells; the probability that the peptide binds to the TAP or the measured or predicted binding affinity of the peptide to the TAP; the expression level of TAP in the tumor cells (which may be measured by RNA-seq, proteome mass spectrometry, immunohistochemistry); presence or absence of tumor mutations, including, but not limited to: driver mutations in known cancer driver genes such as EGFR, KRAS, ALK, RET, ROS1, TP53, CDKN2A, CDKN2B, NTRK1, NTRK2, NTRK3, and in genes encoding the proteins involved in the antigen presentation machinery (e.g., B2M, HLA-A, HLA-B, HLA-C, TAP-1, TAP-2, TAPBP, CALR, CNX, ERP57, HLA-DM, HLA-DMA, HLA-DMB, HLA-DO, HLA-DOA, HLA-DOB, HLA-DP, HLA-DPA1, HLA-DPB1, HLA-DQ, HLA-DQA1, HLA-DQA2, HLA-DQB1, HLA-DQB2, HLA-DR, HLA-DRA, HLA-DRB1, HLA-DRB3, HLA-DRB4, HLA-DRB5 or any of the genes coding for components of the proteasome or immunoproteasome). Peptides whose presentation relies on a component of the antigen-presentation machinery that is subject to loss-of-function mutation in the tumor have reduced probability of presentation; presence or absence of functional germline polymorphisms, including, but not limited to: in genes encoding the proteins involved in the antigen presentation machinery (e.g., B2M, HLA-A, HLA-B, HLA-C, TAP-1, TAP-2, TAPBP, CALR, CNX, ERP57, HLA-DM, HLA-DMA, HLA-DMB, HLA-DO, HLA-DOA, HLA-DOB, HLA-DP, HLA-DPA1, HLA-DPB1, HLA-DQ, HLA-DQA1, HLA-DQA2, HLA-DQB1, HLA-DQB2, HLA-DR, HLA-DRA, HLA-DRB1, HLA-DRB3, HLA-DRB4, HLA-DRB5 or any of the genes coding for components of the proteasome or immunoproteasome); tumor type (e.g., NSCLC, melanoma); clinical tumor subtype (e.g., squamous lung cancer vs. non-squamous); smoking history; the typical expression of the source gene of the peptide in the relevant tumor type or clinical subtype, optionally stratified by driver mutation.

The at least one alteration may be a frameshift or non-frameshift indel, missense or nonsense substitution, splice site alteration, genomic rearrangement or gene fusion, or any genomic or expression alteration giving rise to a neoORF.

The tumor cell may be selected from the group consisting of: lung cancer, melanoma, breast cancer, ovarian cancer, prostate cancer, kidney cancer, gastric cancer, colon cancer, testicular cancer, head and neck cancer, pancreatic cancer, brain cancer, B-cell lymphoma, acute myelogenous leukemia, chronic myelogenous leukemia, chronic lymphocytic leukemia, and T cell lymphocytic leukemia, non-small cell lung cancer, and small cell lung cancer.

A method disclosed herein may also include obtaining a tumor vaccine comprising the set of selected neoantigens or a subset thereof, optionally further comprising administering the tumor vaccine to the subject.

At least one of neoantigens in the set of selected neoantigens, when in polypeptide form, may include at least one of: a binding affinity with MHC with an IC50 value of less than 1000 nM, for MHC Class I polypeptides a length of 8-15, 8, 9, 10, 11, 12, 13, 14, or 15 amino acids, for MHC Class II polypeptides a length of 6-30, 6, 7, 8, 9, 10, 11, 12, 13, 14, 15, 16, 17, 18, 19, 20, 21, 22, 23, 24, 25, 26, 27, 28, 29, or 30 amino acids, presence of sequence motifs within or near the polypeptide in the parent protein sequence promoting proteasome cleavage, and presence of sequence motifs promoting TAP transport. For MHC Class II, presence of sequence motifs within or near the peptide promoting cleavage by extracellular or lysosomal proteases (e.g., cathepsins) or HLA-DM catalyzed HLA binding.

Disclosed herein is are methods for identifying one or more neoantigens that are likely to be presented on a tumor cell surface of a tumor cell, comprising executing the steps of: receiving mass spectrometry data comprising data associated with a plurality of isolated peptides eluted from major histocompatibility complex (MHC) derived from a plurality of fresh or frozen tumor samples; obtaining a training data set by at least identifying a set of training peptide sequences present in the tumor samples and presented on one or more MHC alleles associated with each training peptide sequence; obtaining a set of training protein sequences based on the training peptide sequences; and training a set of numerical parameters of a presentation model using the training protein sequences and the training peptide sequences, the presentation model providing a plurality of numerical likelihoods that peptide sequences from the tumor cell are presented by one or more MHC alleles on the tumor cell surface.

The presentation model may represent dependence between: presence of a pair of a particular one of the MHC alleles and a particular amino acid at a particular position of a peptide sequence; and likelihood of presentation on the tumor cell surface, by the particular one of the MHC alleles of the pair, of such a peptide sequence comprising the particular amino acid at the particular position.

A method disclosed herein can also include selecting a subset of neoantigens, wherein the subset of neoantigens is selected because each has an increased likelihood that it is presented on the cell surface of the tumor relative to one or more distinct tumor neoantigens.

A method disclosed herein can also include selecting a subset of neoantigens, wherein the subset of neoantigens is selected because each has an increased likelihood that it is capable of inducing a tumor-specific immune response in the subject relative to one or more distinct tumor neoantigens.

A method disclosed herein can also include selecting a subset of neoantigens, wherein the subset of neoantigens is selected because each has an increased likelihood that it is capable of being presented to naïve T cells by professional antigen presenting cells (APCs) relative to one or more distinct tumor neoantigens, optionally wherein the APC is a dendritic cell (DC).

A method disclosed herein can also include selecting a subset of neoantigens, wherein the subset of neoantigens is selected because each has a decreased likelihood that it is subject to inhibition via central or peripheral tolerance relative to one or more distinct tumor neoantigens.

A method disclosed herein can also include selecting a subset of neoantigens, wherein the subset of neoantigens is selected because each has a decreased likelihood that it is capable of inducing an autoimmune response to normal tissue in the subject relative to one or more distinct tumor neoantigens.

A method disclosed herein can also include selecting a subset of neoantigens, wherein the subset of neoantigens is selected because each has a decreased likelihood that it will be differentially post-translationally modified in tumor cells versus APCs, optionally wherein the APC is a dendritic cell (DC).

The practice of the methods herein will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W. H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences,* 18th Edition (Easton, Pennsylvania: Mack Publishing Company, 1990); Carey and Sundberg *Advanced Organic Chemistry* $3^{rd}$ *Ed.* (Plenum Press) Vols A and B(1992).

III. Identification of Tumor Specific Mutations in Neoantigens

Also disclosed herein are methods for the identification of certain mutations (e.g., the variants or alleles that are present in cancer cells). In particular, these mutations can be present in the genome, transcriptome, proteome, or exome of cancer cells of a subject having cancer but not in normal tissue from the subject. Specific methods for identifying neoantigens, including shared neoantigens, that are specific to tumors are known to those skilled in the art, for example the methods described in more detail in U.S. Pat. No. 10,055,540, US Application Pub. No. US20200010849A1, and international patent application publications WO/2018/195357 and WO/2018/208856, each herein incorporated by reference, in their entirety, for all purposes.

Genetic mutations in tumors can be considered useful for the immunological targeting of tumors if they lead to changes in the amino acid sequence of a protein exclusively in the tumor. Useful mutations include: (1) non-synonymous mutations leading to different amino acids in the protein; (2) read-through mutations in which a stop codon is modified or deleted, leading to translation of a longer protein with a novel tumor-specific sequence at the C-terminus; (3) splice site mutations that lead to the inclusion of an intron in the mature mRNA and thus a unique tumor-specific protein sequence; (4) chromosomal rearrangements that give rise to a chimeric protein with tumor-specific sequences at the junction of 2 proteins (i.e., gene fusion); (5) frameshift mutations or deletions that lead to a new open reading frame with a novel tumor-specific protein sequence. Mutations can also include one or more of nonframeshift indel, missense or nonsense substitution, splice site alteration, genomic rearrangement or gene fusion, or any genomic or expression alteration giving rise to a neoORF.

Peptides with mutations or mutated polypeptides arising from for example, splice-site, frameshift, readthrough, or gene fusion mutations in tumor cells can be identified by sequencing DNA, RNA or protein in tumor versus normal cells.

Also mutations can include previously identified tumor specific mutations. Known tumor mutations can be found at the Catalogue of Somatic Mutations in Cancer (COSMIC) database.

A variety of methods are available for detecting the presence of a particular mutation or allele in an individual's DNA or RNA. Advancements in this field have provided accurate, easy, and inexpensive large-scale SNP genotyping. For example, several techniques have been described including dynamic allele-specific hybridization (DASH), microplate array diagonal gel electrophoresis (MADGE), pyrosequencing, oligonucleotide-specific ligation, the TaqMan system as well as various DNA "chip" technologies such as the Affymetrix SNP chips. These methods utilize amplification of a target genetic region, typically by PCR. Still other methods, based on the generation of small signal molecules by invasive cleavage followed by mass spectrometry or immobilized padlock probes and rolling-circle amplification. Several of the methods known in the art for detecting specific mutations are summarized below.

PCR based detection means can include multiplex amplification of a plurality of markers simultaneously. For example, it is well known in the art to select PCR primers to generate PCR products that do not overlap in size and can be analyzed simultaneously. Alternatively, it is possible to amplify different markers with primers that are differentially labeled and thus can each be differentially detected. Of course, hybridization based detection means allow the differential detection of multiple PCR products in a sample. Other techniques are known in the art to allow multiplex analyses of a plurality of markers.

Several methods have been developed to facilitate analysis of single nucleotide polymorphisms in genomic DNA or cellular RNA. For example, a single base polymorphism can be detected by using a specialized exonuclease-resistant nucleotide, as disclosed, e.g., in Mundy, C. R. (U.S. Pat. No. 4,656,127). According to the method, a primer complementary to the allelic sequence immediately 3' to the polymorphic site is permitted to hybridize to a target molecule obtained from a particular animal or human. If the polymorphic site on the target molecule contains a nucleotide that is complementary to the particular exonuclease-resistant nucleotide derivative present, then that derivative will be incorporated onto the end of the hybridized primer. Such incorporation renders the primer resistant to exonuclease, and thereby permits its detection. Since the identity of the exonuclease-resistant derivative of the sample is known, a finding that the primer has become resistant to exonucleases reveals that the nucleotide(s) present in the polymorphic site of the target molecule is complementary to that of the nucleotide derivative used in the reaction. This method has the advantage that it does not require the determination of large amounts of extraneous sequence data.

A solution-based method can be used for determining the identity of a nucleotide of a polymorphic site. Cohen, D. et al. (French Patent 2,650,840; PCT Appln. No. WO91/02087). As in the Mundy method of U.S. Pat. No. 4,656,127, a primer is employed that is complementary to allelic sequences immediately 3' to a polymorphic site. The method determines the identity of the nucleotide of that site using labeled dideoxynucleotide derivatives, which, if complementary to the nucleotide of the polymorphic site will become incorporated onto the terminus of the primer.

An alternative method, known as Genetic Bit Analysis or GBA is described by Goelet, P. et al. (PCT Appln. No. 92/15712). The method of Goelet, P. et al. uses mixtures of labeled terminators and a primer that is complementary to the sequence 3' to a polymorphic site. The labeled terminator that is incorporated is thus determined by, and complementary to, the nucleotide present in the polymorphic site of the target molecule being evaluated. In contrast to the method of Cohen et al. (French Patent 2,650,840; PCT Appln. No. WO91/02087) the method of Goelet, P. et al. can be a heterogeneous phase assay, in which the primer or the target molecule is immobilized to a solid phase.

Several primer-guided nucleotide incorporation procedures for assaying polymorphic sites in DNA have been described (Komher, J. S. et al., Nucl. Acids. Res. 17:7779-7784 (1989); Sokolov, B. P., Nucl. Acids Res. 18:3671 (1990); Syvanen, A.-C., et al., Genomics 8:684-692 (1990); Kuppuswamy, M. N. et al., Proc. Natl. Acad. Sci. (U.S.A.) 88:1143-1147 (1991); Prezant, T. R. et al., Hum. Mutat. 1:159-164 (1992); Ugozzoli, L. et al., GATA 9:107-112 (1992); Nyren, P. et al., Anal. Biochem. 208:171-175 (1993)). These methods differ from GBA in that they utilize incorporation of labeled deoxynucleotides to discriminate between bases at a polymorphic site. In such a format, since the signal is proportional to the number of deoxynucleotides incorporated, polymorphisms that occur in runs of the same nucleotide can result in signals that are proportional to the length of the run (Syvanen, A.-C., et al., Amer. J. Hum. Genet. 52:46-59 (1993)).

A number of initiatives obtain sequence information directly from millions of individual molecules of DNA or RNA in parallel. Real-time single molecule sequencing-by-synthesis technologies rely on the detection of fluorescent nucleotides as they are incorporated into a nascent strand of DNA that is complementary to the template being sequenced. In one method, oligonucleotides 30-50 bases in length are covalently anchored at the 5' end to glass cover slips. These anchored strands perform two functions. First, they act as capture sites for the target template strands if the templates are configured with capture tails complementary to the surface-bound oligonucleotides. They also act as primers for the template directed primer extension that forms the basis of the sequence reading. The capture primers function as a fixed position site for sequence determination using multiple cycles of synthesis, detection, and chemical cleavage of the dye-linker to remove the dye. Each cycle consists of adding the polymerase/labeled nucleotide mixture, rinsing, imaging and cleavage of dye. In an alternative method, polymerase is modified with a fluorescent donor molecule and immobilized on a glass slide, while each nucleotide is color-coded with an acceptor fluorescent moiety attached to a gamma-phosphate. The system detects the interaction between a fluorescently-tagged polymerase and a fluorescently modified nucleotide as the nucleotide becomes incorporated into the de novo chain. Other sequencing-by-synthesis technologies also exist.

Any suitable sequencing-by-synthesis platform can be used to identify mutations. As described above, four major sequencing-by-synthesis platforms are currently available: the Genome Sequencers from Roche/454 Life Sciences, the 1G Analyzer from Illumina/Solexa, the SOLiD system from Applied BioSystems, and the Heliscope system from Helicos Biosciences. Sequencing-by-synthesis platforms have also been described by Pacific BioSciences and VisiGen Biotechnologies. In some embodiments, a plurality of nucleic acid molecules being sequenced is bound to a support (e.g., solid support). To immobilize the nucleic acid on a support, a capture sequence/universal priming site can be added at the 3' and/or 5' end of the template. The nucleic acids can be bound to the support by hybridizing the capture sequence to a complementary sequence covalently attached to the support. The capture sequence (also referred to as a universal capture sequence) is a nucleic acid sequence complementary to a sequence attached to a support that may dually serve as a universal primer.

As an alternative to a capture sequence, a member of a coupling pair (such as, e.g., antibody/antigen, receptor/ligand, or the avidin-biotin pair as described in, e.g., US Patent Application No. 2006/0252077) can be linked to each fragment to be captured on a surface coated with a respective second member of that coupling pair.

Subsequent to the capture, the sequence can be analyzed, for example, by single molecule detection/sequencing, e.g., as described in the Examples and in U.S. Pat. No. 7,283,337, including template-dependent sequencing-by-synthesis. In sequencing-by-synthesis, the surface-bound molecule is exposed to a plurality of labeled nucleotide triphosphates in the presence of polymerase. The sequence of the template is determined by the order of labeled nucleotides incorporated into the 3' end of the growing chain. This can be done in real time or can be done in a step-and-repeat mode. For real-time analysis, different optical labels to each nucleotide can be incorporated and multiple lasers can be utilized for stimulation of incorporated nucleotides.

Sequencing can also include other massively parallel sequencing or next generation sequencing (NGS) techniques and platforms. Additional examples of massively parallel sequencing techniques and platforms are the Illumina HiSeq or MiSeq, Thermo PGM or Proton, the Pac Bio RS II or Sequel, Qiagen's Gene Reader, and the Oxford Nanopore MinION. Additional similar current massively parallel sequencing technologies can be used, as well as future generations of these technologies.

Any cell type or tissue can be utilized to obtain nucleic acid samples for use in methods described herein. For example, a DNA or RNA sample can be obtained from a tumor or a bodily fluid, e.g., blood, obtained by known techniques (e.g. venipuncture) or saliva. Alternatively, nucleic acid tests can be performed on dry samples (e.g. hair or skin). In addition, a sample can be obtained for sequencing from a tumor and another sample can be obtained from normal tissue for sequencing where the normal tissue is of the same tissue type as the tumor. A sample can be obtained for sequencing from a tumor and another sample can be obtained from normal tissue for sequencing where the normal tissue is of a distinct tissue type relative to the tumor.

Tumors can include one or more of lung cancer, melanoma, breast cancer, ovarian cancer, prostate cancer, kidney cancer, gastric cancer, colon cancer, testicular cancer, head and neck cancer, pancreatic cancer, brain cancer, B-cell lymphoma, acute myelogenous leukemia, chronic myelogenous leukemia, chronic lymphocytic leukemia, and T cell lymphocytic leukemia, non-small cell lung cancer, and small cell lung cancer.

Alternatively, protein mass spectrometry can be used to identify or validate the presence of mutated peptides bound to MHC proteins on tumor cells. Peptides can be acid-eluted from tumor cells or from HLA molecules that are immunoprecipitated from tumor, and then identified using mass spectrometry.

IV. Antigens

Antigens can include nucleotides or polypeptides. For example, an antigen can be an RNA sequence that encodes for a polypeptide sequence. Antigens useful in vaccines can therefore include nucleic acid sequences or polypeptide sequences.

Disclosed herein are isolated peptides that comprise tumor specific mutations identified by the methods disclosed herein, peptides that comprise known tumor specific mutations, and mutant polypeptides or fragments thereof identified by methods disclosed herein. Neoantigen peptides can be described in the context of their coding sequence where a neoantigen includes the nucleic acid sequence (e.g., DNA or RNA) that codes for the related polypeptide sequence.

Also disclosed herein are peptides derived from any polypeptide known to or have been found to have altered expression in a tumor cell or cancerous tissue in comparison to a normal cell or tissue, for example any polypeptide known to or have been found to be aberrantly expressed in a tumor cell or cancerous tissue in comparison to a normal cell or tissue. Suitable polypeptides from which the antigenic peptides can be derived can be found for example in the COSMIC database. COSMIC curates comprehensive information on somatic mutations in human cancer. The peptide contains the tumor specific mutation.

The modified adenoviral vectors and other constructs described herein can be used to deliver antigens from any organism, including their toxins or other by-products, to prevent and/or treat infection or other adverse reactions associated with the organism or its by-product.

Antigens that can be incorporated into a vaccine (e.g., encoded in a cassette) include immunogens which are useful to immunize a human or non-human animal against viruses, such as pathogenic viruses which infect human and non-human vertebrates. Antigens may be selected from a variety of viral families. Example of desirable viral families against which an immune response would be desirable include, the picornavirus family, which includes the genera rhinoviruses, which are responsible for about 50% of cases of the common cold; the genera enteroviruses, which include polioviruses, coxsackieviruses, echoviruses, and human enteroviruses such as hepatitis A virus; and the genera apthoviruses, which are responsible for foot and mouth diseases, primarily in non-human animals. Within the picornavirus family of viruses, target antigens include the VP1, VP2, VP3, VP4, and VPG. Another viral family includes the calcivirus family, which encompasses the Norwalk group of viruses, which are an important causative agent of epidemic gastroenteritis. Still another viral family desirable for use in targeting antigens for inducing immune responses in humans and non-human animals is the togavirus family, which includes the genera alphavirus, which include Sindbis viruses, RossRiver virus, and Venezuelan, Eastern & Western Equine encephalitis, and rubivirus, including Rubella virus. The Flaviviridae family includes dengue, yellow fever, Japanese encephalitis, St. Louis encephalitis and tick borne encephalitis viruses. Other target antigens may be generated from the Hepatitis C or the coronavirus family, which includes a number of non-human viruses such as infectious bronchitis virus (poultry), porcine transmissible gastroenteric virus (pig), porcine hemagglutinating encephalomyelitis virus (pig), feline infectious peritonitis virus (cats), feline enteric coronavirus (cat), canine coronavirus (dog), and human respiratory coronaviruses, which may cause the common cold and/or non-A, B or C hepatitis. Within the coronavirus family, target antigens include the E1 (also called M or matrix protein), E2 (also called S or Spike protein), E3 (also called HE or hemagglutin-elterose) glycoprotein (not present in all coronaviruses), or N (nucleocapsid). Still other antigens may be targeted against the rhabdovirus family, which includes the genera vesiculovirus (e.g., Vesicular Stomatitis Virus), and the general lyssavirus (e.g., rabies). Within the rhabdovirus family, suitable antigens may be derived from the G protein or the N protein. The family filoviridae, which includes hemorrhagic fever viruses such as Marburg and Ebola virus, may be a suitable source of antigens. The paramyxovirus family includes parainfluenza Virus Type 1, parainfluenza Virus Type 3, bovine parainfluenza Virus Type 3, rubulavirus (mumps virus), parainfluenza Virus Type 2, parainfluenza virus Type 4, Newcastle disease virus (chickens), rinderpest, morbillivirus, which includes measles and canine distemper, and pneumovirus, which includes respiratory syncytial virus (e.g., the glyco-(G) protein and the fusion (F) protein, for which sequences are available from GenBank). Influenza virus is classified within the family orthomyxovirus and can be suitable source of antigens (e.g., the HA protein, the N1 protein). The bunyavirus family includes the genera bunyavirus (California encephalitis, La Crosse), phlebovirus (Rift Valley Fever), hantavirus (puremala is a hemahagin fever virus), nairovirus (Nairobi sheep disease) and various unassigned bungaviruses. The arenavirus family provides a source of antigens against LCM and Lassa fever virus. The reovirus family includes the genera reovirus, rotavirus (which causes acute gastroenteritis in children), orbiviruses, and cultivirus (Colorado Tick fever, Lebombo (humans), equine encephalosis, blue tongue). The retrovirus family includes the sub-family oncorivirinal which encompasses such human and veterinary diseases as feline leukemia virus, HTLVI and HTLVII, lentivirinal (which includes human immunodeficiency virus (HIV), simian immunodeficiency virus (SIV), feline immunodeficiency virus (FIV), equine infectious anemia virus, and spumavirinal). Among the lentiviruses, many suitable antigens have been described and can readily be selected. Examples of suitable HIV and SIV antigens include, without limitation the gag, pol, Vif, Vpx, VPR, Env, Tat, Nef, and Rev proteins, as well as various fragments thereof. For example, suitable fragments of the Env protein may include any of its subunits such as the gp120, gp160, gp41, or smaller fragments thereof, e.g., of at least about 8 amino acids in length. Similarly, fragments of the tat protein may be selected. [See, U.S. Pat. Nos. 5,891,994 and 6,193,981.] See, also, the HIV and SIV proteins described in D. H. Barouch et al, J. Virol., 75(5):2462-2467 (March 2001), and R. R. Amara, et al, *Science*, 292:69-74 (6 Apr. 2001). In another example, the HIV and/or SIV immunogenic proteins or peptides may be used to form fusion proteins or other immunogenic molecules. See, e.g., the HIV-1 Tat and/or Nef fusion proteins and immunization regimens described in WO 01/54719, published Aug. 2, 2001, and WO 99/16884, published Apr. 8, 1999. The invention is not limited to the HIV and/or SIV immunogenic proteins or peptides described herein. In addition, a variety of modifications to these proteins have been described or could readily be made by one of skill in the art. See, e.g., the modified gag protein that is described in U.S. Pat. No. 5,972,596. Further, any desired HIV and/or SIV immunogens may be delivered alone or in combination. Such combinations may include expression from a single vector or from multiple vectors. The papovavirus family includes the sub-family polyomaviruses (BKU and JCU viruses) and the sub-family papillomavirus (associated with cancers or malignant progression of papilloma). The adenovirus family includes viruses (EX, AD7, ARD, O.B.) which cause respiratory disease and/or enteritis. The parvovirus family feline parvovirus (feline enteritis), feline panleucopeniavirus, canine parvovirus, and porcine parvovirus. The herpesvirus family includes the sub-family alphaherpesvirinae, which encompasses the genera simplexvirus (HSVI, HSVII), varicellovirus (pseudorabies, varicella zoster) and the sub-family betaherpesvirinae, which includes the genera cytomegalovirus (Human CMV), muromegalovirus) and the sub-family gammaherpesvirinae, which includes the genera lymphocryptovirus, EBV (Burkitts lymphoma), infectious rhinotracheitis, Marek's disease virus, and rhadinovirus. The poxvirus family includes the sub-family chordopoxyirinae, which encompasses the genera orthopoxvirus (Variola (Smallpox) and Vaccinia (Cowpox)), parapoxvirus, avipoxvirus, capripoxvirus, leporipoxvirus, suipoxvirus, and the sub-family entomopoxyirinae. The hepadnavirus family includes the Hepatitis B virus. One unclassified virus which may be suitable source of antigens is the Hepatitis delta virus. Still other viral sources may include avian infectious bursal disease virus and porcine respiratory and reproductive syndrome virus. The alphavirus family includes equine arteritis virus and various Encephalitis viruses.

Antigens that can be incorporated into a vaccine (e.g., encoded in a cassette) also include immunogens which are useful to immunize a human or non-human animal against pathogens including bacteria, fungi, parasitic microorganisms or multicellular parasites which infect human and non-human vertebrates. Examples of bacterial pathogens include pathogenic gram-positive cocci include pneumococci; staphylococci; and streptococci. Pathogenic gram-negative cocci include meningococcus; gonococcus. Pathogenic enteric gram-negative bacilli include enterobacteriaceae; *pseudomonas*, acinetobacteria and *eikenella*; melioidosis; *salmonella; shigella; haemophilus* (*Haemophilus influenzae, Haemophilus somnus*); *moraxella; H. ducreyi* (which causes chancroid); *brucella; Franisella tularensis* (which causes tularemia); *yersinia* (*pasteurella*); *streptobacillus moniliformis* and *spirillum*. Gram-positive bacilli include *Listeria monocytogenes; erysipelothrix rhusiopathiae; Corynebacterium diphtheria* (diphtheria); cholera; *B. anthracis* (anthrax); donovanosis (granuloma inguinale); and bartonellosis. Diseases caused by pathogenic anaerobic bacteria include tetanus; botulism; other clostridia; tuberculosis; leprosy; and other mycobacteria. Examples of specific bacterium species are, without limitation, *Streptococcus pneumoniae, Streptococcus pyogenes, Streptococcus agalactiae, Streptococcus faecalis, Moraxella catarrhalis, Helicobacter pylori, Neisseria meningitidis, Neisseria gonorrhoeae, Chlamydia trachomatis, Chlamydia pneumoniae, Chlamydia psittaci, Bordetella pertussis, Salmonella typhi, Salmonella typhimurium, Salmonella choleraesuis, Escherichia coli, Shigella, Vibrio cholerae, Corynebacterium diphtheriae, Mycobacterium tuberculosis, Mycobacterium avium, Mycobacterium intracellulare* complex, *Proteus mirabilis, Proteus vulgaris, Staphylococcus aureus, Clostridium tetani, Leptospira interrogans, Borrelia burgdorferi, Pasteurella haemolytica, Pasteurella multocida, Actinobacillus pleuropneumoniae* and *Mycoplasma gallisepticum*. Pathogenic spirochetal diseases include syphilis; treponematoses: yaws, pinta and endemic syphilis; and leptospirosis. Other infections caused by higher pathogen bacteria and pathogenic fungi include actinomycosis; nocardiosis; cryptococcosis (*Cryptococcus*), blastomycosis (*Blastomyces*), histoplasmosis (*Histoplasma*) and coccidioidomycosis (*Coccidiodes*); candidiasis (*Candida*), aspergillosis (*Aspergillis*), and mucormycosis; sporotrichosis; paracoccidiodomycosis, petriellidiosis, torulopsosis, mycetoma and chromomycosis; and dermatophytosis. Rickettsial infections include Typhus fever, Rocky Mountain spotted fever, Q fever, and Rickettsialpox. Examples of mycoplasma and chlamydial infections include: *Mycoplasma pneumoniae*; lymphogranuloma venereum; psittacosis; and perinatal chlamydial infections. Pathogenic eukaryotes encompass pathogenic protozoans and helminths and infections produced thereby include: amebiasis; malaria; leishmaniasis (e.g., caused by *Leishmania major*); trypanosomiasis; toxoplasmosis (e.g., caused by *Toxoplasma gondii*); *Pneumocystis carinii*; Trichans; *Toxoplasma gondii*; babesiosis; giardiasis (e.g., caused by Giardia); trichinosis (e.g., caused by *Trichomonas*); filariasis; schistosomiasis (e.g., caused by *Schistosoma*); nematodes; trematodes or flukes; and cestode (tapeworm) infections. Other parasitic infections may be caused by *Ascaris, Trichuris, Cryptosporidium*, and *Pneumocystis carinii*, among others.

Also disclosed herein are peptides derived from any polypeptide associated with an infectious disease organism, an infection in a subject, or an infected cell of a subject. Antigens can be derived from nucleic acid sequences or polypeptide sequences of an infectious disease organism. Polypeptide sequences of an infectious disease organism include, but are not limited to, a pathogen-derived peptide, a virus-derived peptide, a bacteria-derived peptide, a fungus-derived peptide, and/or a parasite-derived peptide. Infectious disease organism include, but are not limited to, Severe acute respiratory syndrome-related coronavirus (SARS), severe acute respiratory syndrome coronavirus 2 (SARS-CoV-2), Ebola, HIV, Hepatitis B virus (HBV), influenza, Hepatitis C virus (HCV), and tuberculosis.

Antigens can be selected that are predicted to be presented on the cell surface of a cell, such as a tumor cell, an infected cell, or an immune cell, including professional antigen presenting cells such as dendritic cells. Antigens can be selected that are predicted to be immunogenic.

One or more polypeptides encoded by an antigen nucleic acid sequence can comprise at least one of: a binding affinity with MHC with an IC50 value of less than 1000 nM, for MHC Class I peptides a length of 8-15, 8, 9, 10, 11, 12, 13, 14, or 15 amino acids, presence of sequence motifs within or near the peptide promoting proteasome cleavage, and presence or sequence motifs promoting TAP transport. For MHC Class II peptides a length 6-30, 6, 7, 8, 9, 10, 11, 12, 13, 14, 15, 16, 17, 18, 19, 20, 21, 22, 23, 24, 25, 26, 27, 28, 29, or 30 amino acids, presence of sequence motifs within or near the peptide promoting cleavage by extracellular or lysosomal proteases (e.g., cathepsins) or HLA-DM catalyzed HLA binding.

One or more antigens can be presented on the surface of a tumor. One or more antigens can be presented on the surface of an infected cell.

One or more antigens can be immunogenic in a subject having a tumor, e.g., capable of eliciting a T cell response or a B cell response in the subject. One or more antigens can be immunogenic in a subject having or suspected to have an infection, e.g., capable of eliciting a T cell response or a B cell response in the subject. One or more antigens can be immunogenic in a subject at risk of an infection, e.g., capable of eliciting a T cell response or a B cell response in the subject that provides immunological protection (i.e., immunity) against the infection, e.g., such as stimulating the production of memory T cells, memory B cells, or antibodies specific to the infection.

One or more antigens can be capable of eliciting a B cell response, such as the production of antibodies that recognize the one or more antigens. Antibodies can recognize linear polypeptide sequences or recognize secondary and tertiary structures. Accordingly, B cell antigens can include linear polypeptide sequences or polypeptides having secondary and tertiary structures, including, but not limited to, full-length proteins, protein subunits, protein domains, or any polypeptide sequence known or predicted to have secondary and tertiary structures.

One or more antigens that induce an autoimmune response in a subject can be excluded from consideration in the context of vaccine generation for a subject.

The size of at least one antigenic peptide molecule (e.g., an epitope sequence) can comprise, but is not limited to, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 41, about 42, about 43, about 44, about 45, about 46, about 47, about 48, about 49, about 50, about 60, about 70, about 80, about 90, about 100, about 110, about 120 or greater amino molecule residues, and any range derivable therein. In specific embodiments the antigenic peptide molecules are equal to or less than 50 amino acids.

Antigenic peptides and polypeptides can be: for MHC Class I 15 residues or less in length and usually consist of between about 8 and about 11 residues, particularly 9 or 10 residues; for MHC Class II, 6-30 residues, inclusive.

If desirable, a longer peptide can be designed in several ways. In one case, when presentation likelihoods of peptides on HLA alleles are predicted or known, a longer peptide could consist of either: (1) individual presented peptides with an extensions of 2-5 amino acids toward the N- and C-terminus of each corresponding gene product; (2) a concatenation of some or all of the presented peptides with extended sequences for each. In another case, when sequencing reveals a long (>10 residues) neoepitope sequence present in the tumor (e.g. due to a frameshift, read-through or intron inclusion that leads to a novel peptide sequence), a longer peptide would consist of: (3) the entire stretch of novel tumor-specific or infectious disease-specific amino acids—thus bypassing the need for computational or in vitro test-based selection of the strongest HLA-presented shorter peptide. In both cases, use of a longer peptide allows endogenous processing by patient cells and may lead to more effective antigen presentation and induction of T cell responses.

Antigenic peptides and polypeptides can be presented on an HLA protein. In some aspects antigenic peptides and polypeptides are presented on an HLA protein with greater affinity than a wild-type peptide. In some aspects, an antigenic peptide or polypeptide can have an IC50 of at least less than 5000 nM, at least less than 1000 nM, at least less than 500 nM, at least less than 250 nM, at least less than 200 nM, at least less than 150 nM, at least less than 100 nM, at least less than 50 nM or less.

In some aspects, antigenic peptides and polypeptides do not induce an autoimmune response and/or invoke immunological tolerance when administered to a subject.

Also provided are compositions comprising at least two or more antigenic peptides. In some embodiments the composition contains at least two distinct peptides. At least two distinct peptides can be derived from the same polypeptide. By distinct polypeptides is meant that the peptide vary by length, amino acid sequence, or both. The peptides can be derived from any polypeptide known to or have been found to contain a tumor specific mutation or peptides derived from any polypeptide known to or have been found to have altered expression in a tumor cell or cancerous tissue in comparison to a normal cell or tissue, for example any polypeptide known to or have been found to be aberrantly expressed in a tumor cell or cancerous tissue in comparison to a normal cell or tissue. Suitable polypeptides from which the antigenic peptides can be derived can be found for example in the COSMIC database or the AACR Genomics Evidence Neoplasia Information Exchange (GENIE) database. COSMIC curates comprehensive information on somatic mutations in human cancer. AACR GENIE aggregates and links clinical-grade cancer genomic data with clinical outcomes from tens of thousands of cancer patients. In some aspects the tumor specific mutation is a driver mutation for a particular cancer type. The peptides can be derived from any polypeptide known to or suspected to be associated with an infectious disease organism, or peptides derived from any polypeptide known to or have been found to have altered expression in an infected cell in comparison to a normal cell or tissue (e.g., an infectious disease polynucleotide or polypeptide, including infectious disease polynucleotides or polypeptides with expression restricted to a host cell).

Antigenic peptides and polypeptides having a desired activity or property can be modified to provide certain desired attributes, e.g., improved pharmacological characteristics, while increasing or at least retaining substantially all of the biological activity of the unmodified peptide to bind the desired MHC molecule and activate the appropriate T cell. For instance, antigenic peptide and polypeptides can be subject to various changes, such as substitutions, either conservative or non-conservative, where such changes might provide for certain advantages in their use, such as improved MHC binding, stability or presentation. By conservative substitutions is meant replacing an amino acid residue with another which is biologically and/or chemically similar, e.g., one hydrophobic residue for another, or one polar residue for another. The substitutions include combinations such as Gly, Ala; Val, Ile, Leu, Met; Asp, Glu; Asn, Gln; Ser, Thr; Lys, Arg; and Phe, Tyr. The effect of single amino acid substitutions may also be probed using D-amino acids. Such modifications can be made using well known peptide synthesis procedures, as described in e.g., Merrifield, Science 232:341-347 (1986), Barany & Merrifield, The Peptides, Gross & Meienhofer, eds. (N.Y., Academic Press), pp. 1-284 (1979); and Stewart & Young, Solid Phase Peptide Synthesis, (Rockford, Ill., Pierce), 2d Ed. (1984).

Modifications of peptides and polypeptides with various amino acid mimetics or unnatural amino acids can be particularly useful in increasing the stability of the peptide and polypeptide in vivo. Stability can be assayed in a number of ways. For instance, peptidases and various biological media, such as human plasma and serum, have been used to test stability. See, e.g., Verhoef et al., Eur. J. Drug Metab Pharmacokin. 11:291-302 (1986). Half-life of the peptides can be conveniently determined using a 25% human serum (v/v) assay. The protocol is generally as follows. Pooled human serum (Type AB, non-heat inactivated) is delipidated by centrifugation before use. The serum is then diluted to 25% with RPMI tissue culture media and used to test peptide stability. At predetermined time intervals a small amount of reaction solution is removed and added to either 6% aqueous trichloracetic acid or ethanol. The cloudy reaction sample is cooled (4 degrees C.) for 15 minutes and then spun to pellet the precipitated serum proteins. The presence of the peptides is then determined by reversed-phase HPLC using stability-specific chromatography conditions.

The peptides and polypeptides can be modified to provide desired attributes other than improved serum half-life. For instance, the ability of the peptides to induce CTL activity can be enhanced by linkage to a sequence which contains at least one epitope that is capable of inducing a T helper cell response. Immunogenic peptides/T helper conjugates can be linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus can be a hetero- or homo-oligomer. When present, the spacer will usually be at least one or two residues, more usually three to six residues. Alternatively, the peptide can be linked to the T helper peptide without a spacer.

An antigenic peptide can be linked to the T helper peptide either directly or via a spacer either at the amino or carboxy terminus of the peptide. The amino terminus of either the antigenic peptide or the T helper peptide can be acylated. Exemplary T helper peptides include tetanus toxoid 830-843, influenza 307-319, malaria circumsporozoite 382-398 and 378-389.

Proteins or peptides can be made by any technique known to those of skill in the art, including the expression of proteins, polypeptides or peptides through standard molecular biological techniques, the isolation of proteins or peptides from natural sources, or the chemical synthesis of proteins or peptides. The nucleotide and protein, polypeptide and peptide sequences corresponding to various genes have been previously disclosed, and can be found at computerized databases known to those of ordinary skill in the art. One such database is the National Center for Biotechnology Information's Genbank and GenPept databases located at the National Institutes of Health website. The coding regions for known genes can be amplified and/or expressed using the techniques disclosed herein or as would be known to those of ordinary skill in the art. Alternatively, various commercial preparations of proteins, polypeptides and peptides are known to those of skill in the art.

In a further aspect an antigen includes a nucleic acid (e.g. polynucleotide) that encodes an antigenic peptide or portion thereof. The polynucleotide can be, e.g., DNA, cDNA, PNA, CNA, RNA (e.g., mRNA), either single- and/or double-stranded, or native or stabilized forms of polynucleotides, such as, e.g., polynucleotides with a phosphorothioate backbone, or combinations thereof and it may or may not contain introns. A still further aspect provides an expression vector capable of expressing a polypeptide or portion thereof. Expression vectors for different cell types are well known in the art and can be selected without undue experimentation. Generally, DNA is inserted into an expression vector, such as a plasmid, in proper orientation and correct reading frame for expression. If necessary, DNA can be linked to the appropriate transcriptional and translational regulatory control nucleic acid sequences recognized by the desired host, although such controls are generally available in the expression vector. The vector is then introduced into the host through standard techniques. Guidance can be found e.g. in Sambrook et al. (1989) Molecular Cloning, A Laboratory Manual, Cold Spring Harbor Laboratory, Cold Spring Harbor, N.Y.

V. Delivery Compositions

Also disclosed herein is an immunogenic composition, e.g., a vaccine composition, capable of raising a specific immune response, e.g., a tumor-specific immune response or an infectious disease organism-specific immune response. Vaccine compositions typically comprise one or a plurality of antigens, e.g., selected using a method described herein. Vaccine compositions can also be referred to as vaccines.

A vaccine can contain between 1 and 30 peptides, 2, 3, 4, 5, 6, 7, 8, 9, 10, 11, 12, 13, 14, 15, 16, 17, 18, 19, 20, 21, 22, 23, 24, 25, 26, 27, 28, 29, or 30 different peptides, 6, 7, 8, 9, 10 11, 12, 13, or 14 different peptides, or 12, 13 or 14 different peptides. Peptides can include post-translational modifications. A vaccine can contain between 1 and 100 or more nucleic acid sequences, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different nucleic acid sequences, 6, 7, 8, 9, 10 11, 12, 13, or 14 different nucleic acid sequences, or 12, 13 or 14 different nucleic acid sequences. A vaccine can contain between 1 and 30 antigen sequences, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different antigen sequences, 6, 7, 8, 9, 10 11, 12, 13, or 14 different antigen sequences, or 12, 13 or 14 different antigen sequences.

A vaccine can contain between 1 and 30 antigen-encoding nucleic acid sequences, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more different antigen-encoding nucleic acid sequences, 6, 7, 8, 9, 10 11, 12, 13, or 14 different antigen-encoding nucleic acid sequences, or 12, 13 or 14 different antigen-encoding nucleic acid sequences. Antigen-encoding nucleic acid sequences can refer to the antigen encoding portion of an antigen "cassette." Features of an cassette are described in greater detail below.

A vaccine can contain between 1 and 30 distinct epitope-encoding nucleic acid sequences, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more distinct epitope-encoding nucleic acid sequences, 6, 7, 8, 9, 10 11, 12, 13, or 14 distinct epitope-encoding nucleic acid sequences, or 12, 13 or 14 distinct epitope-encoding nucleic acid sequences. Epitope-encoding nucleic acid sequences can refer to sequences for individual epitope sequences.

A vaccine can contain at least two repeats of an epitope-encoding nucleic acid sequence. A used herein, a "repeat" refers to two or more iterations of an identical nucleic acid epitope-encoding nucleic acid sequence (inclusive of the optional 5' linker sequence and/or the optional 3' linker sequences described herein) within an antigen-encoding nucleic acid sequence. In one example, the antigen-encoding nucleic acid sequence portion of a cassette encodes at least two repeats of an epitope-encoding nucleic acid sequence. In further non-limiting examples, the antigen-encoding nucleic acid sequence portion of a cassette encodes more than one distinct epitope, and at least one of the distinct epitopes is encoded by at least two repeats of the nucleic acid sequence encoding the distinct epitope (i.e., at least two distinct epitope-encoding nucleic acid sequences). In illustrative non-limiting examples, an antigen-encoding nucleic acid sequence encodes epitopes A, B, and C encoded by epitope-encoding nucleic acid sequences epitope-encoding sequence A ($E_A$), epitope-encoding sequence B ($E_B$), and epitope-encoding sequence C ($E_C$), and exemplary antigen-encoding nucleic acid sequences having repeats of at least one of the distinct epitopes are illustrated by, but is not limited to, the formulas below:

Repeat of one distinct epitope (repeat of epitope A):

$E_A$-$E_B$-$E_C$-$E_A$; or $E_A$-$E_A$-$E_B$-$E_C$

Repeat of multiple distinct epitopes (repeats of epitopes A, B, and C):

$E_A$-$E_B$-$E_C$-$E_A$-$E_B$-$E_C$; or $E_A$-$E_A$-$E_A$-$E_B$-$E_B$-$E_B$-$E_C$-$E_C$-$E_C$

Multiple repeats of multiple distinct epitopes (repeats of epitopes A, B, and C):

$E_A$-$E_B$-$E_C$-$E_A$-$E_B$-$E_C$-$E_A$-$E_B$-$E_C$; or $E_A$-$E_A$-$E_A$-$E_B$-$E_B$-$E_B$-$E_C$-$E_C$-$E_C$

The above examples are not limiting and the antigen-encoding nucleic acid sequences having repeats of at least one of the distinct epitopes can encode each of the distinct epitopes in any order or frequency. For example, the order and frequency can be a random arrangement of the distinct epitopes, e.g., in an example with epitopes A, B, and C, by the formula $E_A$-$E_B$-$E_C$-$E_C$-$E_A$-$E_B$-$E_A$-$E_C$-$E_A$-$E_C$-$E_C$-$E_B$.

Also provided for herein is an antigen-encoding cassette, the antigen-encoding cassette having at least one antigen-encoding nucleic acid sequence described, from 5' to 3' by the formula:

$(E_x\text{-}(E^N_n)_y)_z$ where E represents a nucleic acid sequence comprising at least one of the at least one distinct epitope-encoding nucleic acid sequences, n represents the number of separate distinct epitope-encoding nucleic acid sequences and is any integer including 0, $E^N$ represents a nucleic acid sequence comprising the separate distinct epitope-encoding nucleic acid sequence for each corresponding n, for each iteration of z: x=0 or 1, y=0 or 1 for each n, and at least one of x or y=1, and z=2 or greater, wherein the antigen-encoding nucleic acid sequence comprises at least two iterations of E, a given $E^N$, or a combination thereof.

Each E or $E^N$ can independently comprise any epitope-encoding nucleic acid sequence described herein. For example, Each E or $E^N$ can independently comprises a nucleic acid sequence described, from 5' to 3', by the formula ($L5_b$-$N_c$-$L3_d$), where N comprises the distinct epitope-encoding nucleic acid sequence associated with each E or $E^N$, where c=1, L5 comprises a 5' linker sequence, where b=0 or 1, and L3 comprises a 3' linker sequence, where d=0 or 1. Epitopes and linkers that can be used are further described herein, e.g., see "V. A. Cassettes" section.

Repeats of an epitope-encoding nucleic acid sequences (inclusive of optional 5' linker sequence and/or the optional 3' linker sequences) can be linearly linked directly to one another (e.g., $E_A$-$E_A$- . . . as illustrated above). Repeats of an epitope-encoding nucleic acid sequences can be separated by one or more additional nucleotides sequences. In general, repeats of an epitope-encoding nucleic acid sequences can be separated by any size nucleic acid sequence applicable for the compositions described herein. In one example, repeats of an epitope-encoding nucleic acid sequences can be separated by a separate distinct epitope-encoding nucleic acid sequence (e.g., $E_A$-$E_B$-$E_C$-$E_A$ . . . , as illustrated above). In examples where repeats are separated by a single separate distinct epitope-encoding nucleic acid sequence, and each epitope-encoding nucleic acid sequences (inclusive of optional 5' linker sequence and/or the optional 3' linker sequences) encodes a peptide 25 amino acids in length, the repeats can be separated by 75 nucleotides, such as in antigen-encoding nucleic acid represented by $E_A$-$E_B$-$E_A$ . . . , $E_A$ is separated by 75 nucleotides. In an illustrative example, an antigen-encoding nucleic acid having the sequence (SEQ ID NO: 74)
VTNTEMFVTAPDNLGYMYEVQWPGQTQPQIANCSVYDFFVWLHYYSVRDT

VTNTEMFVTAPDNLGYMYEVQWPGQTQPQIANCSVYDFFVWLHYYSVRDT encoding repeats of 25mer antigens Trp1 (VTNTEMFVTAPDNLGYMYEVQWPGQ (SEQ ID NO: 75)) and Trp2 (TQPQIANCSVYDFFVWLHYYSVRDT (SEQ ID NO: 76)), the repeats of Trp1 are separated by the 25mer Trp2 and thus the repeats of the Trp1 epitope-encoding nucleic acid sequences are separated the 75 nucleotide Trp2 epitope-encoding nucleic acid sequence. In examples where repeats are separated by 2, 3, 4, 5, 6, 7, 8, or 9 separate distinct epitope-encoding nucleic acid sequence, and each epitope-encoding nucleic acid sequences (inclusive of optional 5' linker sequence and/or the optional 3' linker sequences) encodes a peptide 25 amino acids in length, the repeats can be separated by 150, 225, 300, 375, 450, 525, 600, or 675 nucleotides, respectively.

In one embodiment, different peptides and/or polypeptides or nucleic acid sequences encoding them are selected so that the peptides and/or polypeptides capable of associating with different MHC molecules, such as different MHC class I molecules and/or different MHC class II molecules. In some aspects, one vaccine composition comprises coding sequence for peptides and/or polypeptides capable of associating with the most frequently occurring MHC class I molecules and/or different MHC class II molecules. Hence, vaccine compositions can comprise different fragments capable of associating with at least 2 preferred, at least 3 preferred, or at least 4 preferred MHC class I molecules and/or different MHC class II molecules.

The vaccine composition can be capable of raising a specific cytotoxic T-cells response and/or a specific helper T-cell response.

A vaccine composition can further comprise an adjuvant and/or a carrier. Examples of useful adjuvants and carriers are given herein below. A composition can be associated with a carrier such as e.g. a protein or an antigen-presenting cell such as e.g. a dendritic cell (DC) capable of presenting the peptide to a T-cell.

Adjuvants are any substance whose admixture into a vaccine composition increases or otherwise modifies the immune response to an antigen. Carriers can be scaffold structures, for example a polypeptide or a polysaccharide, to which an antigen, is capable of being associated. Optionally, adjuvants are conjugated covalently or non-covalently.

The ability of an adjuvant to increase an immune response to an antigen is typically manifested by a significant or substantial increase in an immune-mediated reaction, or reduction in disease symptoms. For example, an increase in humoral immunity is typically manifested by a significant increase in the titer of antibodies raised to the antigen, and an increase in T-cell activity is typically manifested in increased cell proliferation, or cellular cytotoxicity, or cytokine secretion. An adjuvant may also alter an immune response, for example, by changing a primarily humoral or Th response into a primarily cellular, or Th response.

Suitable adjuvants include, but are not limited to 1018 ISS, alum, aluminum salts, Amplivax, AS15, BCG, CP-870, 893, CpG7909, CyaA, dSLIM, GM-CSF, IC30, IC31, Imiquimod, ImuFact IMP321, IS Patch, ISS, ISCOMATRIX, JuvImmune, LipoVac, MF59, monophosphoryl lipid A, Montanide IMS 1312, Montanide ISA 206, Montanide ISA 50V, Montanide ISA-51, OK-432, OM-174, OM-197-MP-$E_C$, ONTAK, PepTel vector system, PLG microparticles, resiquimod, SRL172, Virosomes and other Virus-like particles, YF-17D, VEGF trap, R848, beta-glucan, Pam3Cys, Aquila's QS21 stimulon (Aquila Biotech, Worcester, Mass., USA) which is derived from saponin, mycobacterial extracts and synthetic bacterial cell wall mimics, and other proprietary adjuvants such as Ribi's Detox. Quil or Superfos. Adjuvants such as incomplete Freund's or GM-CSF are useful. Several immunological adjuvants (e.g., MF59) specific for dendritic cells and their preparation have been described previously (Dupuis M, et al., Cell Immunol. 1998; 186(1):18-27; Allison A C; Dev Biol Stand. 1998; 92:3-11). Also cytokines can be used. Several cytokines have been directly linked to influencing dendritic cell migration to lymphoid tissues (e.g., TNF-alpha), accelerating the maturation of dendritic cells into efficient antigen-presenting cells for T-lymphocytes (e.g., GM-CSF, IL-1 and IL-4) (U.S. Pat. No. 5,849,589, specifically incorporated herein by reference in its entirety) and acting as immunoadjuvants (e.g., IL-12) (Gabrilovich D I, et al., J Immunother Emphasis Tumor Immunol. 1996 (6):414-418).

CpG immunostimulatory oligonucleotides have also been reported to enhance the effects of adjuvants in a vaccine setting. Other TLR binding molecules such as RNA binding TLR 7, TLR 8 and/or TLR 9 may also be used.

Other examples of useful adjuvants include, but are not limited to, chemically modified CpGs (e.g. CpR, Idera), Poly(I:C)(e.g. polyi:CI2U), non-CpG bacterial DNA or RNA as well as immunoactive small molecules and antibodies such as cyclophosphamide, sunitinib, bevacizumab, celebrex, NCX-4016, sildenafil, tadalafil, vardenafil, sorafinib, XL-999, CP-547632, pazopanib, ZD2171, AZD2171, ipilimumab, tremelimumab, and SC58175, which may act therapeutically and/or as an adjuvant. The amounts and concentrations of adjuvants and additives can readily be determined by the skilled artisan without undue experimentation. Additional adjuvants include colony-stimulating factors, such as Granulocyte Macrophage Colony Stimulating Factor (GM-CSF, sargramostim).

A vaccine composition can comprise more than one different adjuvant. Furthermore, a therapeutic composition can comprise any adjuvant substance including any of the above or combinations thereof. It is also contemplated that a vaccine and an adjuvant can be administered together or separately in any appropriate sequence.

A carrier (or excipient) can be present independently of an adjuvant. The function of a carrier can for example be to increase the molecular weight of in particular mutant to increase activity or immunogenicity, to confer stability, to increase the biological activity, or to increase serum half-life. Furthermore, a carrier can aid presenting peptides to T-cells. A carrier can be any suitable carrier known to the person skilled in the art, for example a protein or an antigen presenting cell. A carrier protein could be but is not limited to keyhole limpet hemocyanin, serum proteins such as transferrin, bovine serum albumin, human serum albumin, thyroglobulin or ovalbumin, immunoglobulins, or hormones, such as insulin or palmitic acid. For immunization of humans, the carrier is generally a physiologically acceptable carrier acceptable to humans and safe. However, tetanus toxoid and/or diptheria toxoid are suitable carriers. Alternatively, the carrier can be dextrans for example sepharose.

Cytotoxic T-cells (CTLs) recognize an antigen in the form of a peptide bound to an MHC molecule rather than the intact foreign antigen itself. The MHC molecule itself is located at the cell surface of an antigen presenting cell. Thus, an activation of CTLs is possible if a trimeric complex of peptide antigen, MHC molecule, and APC is present. Correspondingly, it may enhance the immune response if not only the peptide is used for activation of CTLs, but if additionally APCs with the respective MHC molecule are added. Therefore, in some embodiments a vaccine composition additionally contains at least one antigen presenting cell.

Antigens can also be included in viral vector-based vaccine platforms, such as vaccinia, fowlpox, self-replicating alphavirus, marabavirus, adenovirus (See, e.g., Tatsis et al., Adenoviruses, *Molecular Therapy* (2004) 10, 616-629), or lentivirus, including but not limited to second, third or hybrid second/third generation lentivirus and recombinant lentivirus of any generation designed to target specific cell types or receptors (See, e.g., Hu et al., Immunization Delivered by Lentiviral Vectors for Cancer and Infectious Diseases, *Immunol Rev*. (2011) 239(1): 45-61, Sakuma et al., Lentiviral vectors: basic to translational, *Biochem J*. (2012) 443(3):603-18, Cooper et al., Rescue of splicing-mediated intron loss maximizes expression in lentiviral vectors containing the human ubiquitin C promoter, *Nucl. Acids Res*. (2015) 43 (1): 682-690, Zufferey et al., Self-Inactivating Lentivirus Vector for Safe and Efficient In Vivo Gene Delivery, *J. Virol*. (1998) 72 (12): 9873-9880). Dependent on the packaging capacity of the above mentioned viral vector-based vaccine platforms, this approach can deliver one or more nucleic acid sequences that encode one or more antigenic peptides. The sequences may be flanked by non-mutated sequences, may be separated by linkers or may be preceded with one or more sequences targeting a subcellular compartment (See, e.g., Gros et al., Prospective identification of neoantigen-specific lymphocytes in the peripheral blood of melanoma patients, *Nat Med*. (2016) 22 (4):433-8, Stronen et al., Targeting of cancer neoantigens with donor-derived T cell receptor repertoires, *Science*. (2016) 352 (6291):1337-41, Lu et al., Efficient identification of mutated cancer antigens recognized by T cells associated with durable tumor regressions, *Clin Cancer Res*. (2014) 20(13): 3401-10). Upon introduction into a host, infected cells express the antigens, and thereby elicit a host immune (e.g., CTL) response against the peptide(s). Vaccinia vectors and methods useful in immunization protocols are described in, e.g., U.S. Pat. No. 4,722,848. Another vector is BCG (Bacille Calmette Guerin). BCG vectors are described in Stover et al. (Nature 351:456-460 (1991)). A wide variety of other vaccine vectors useful for therapeutic administration or immunization of antigens, e.g., *Salmonella typhi* vectors, and the like will be apparent to those skilled in the art from the description herein.

Also disclosed herein is an adenoviral vector delivery composition capable of delivering one or more payload nucleic acid sequences. A payload nucleic acid sequence can be any nucleic acid sequence desired to be delivered to a cell of interest. In general, the payload is a nucleic acid sequence linked to a promoter to drive expression of the nucleic acid sequence. The payload nucleic acid sequence can encode a polypeptide (i.e., a nucleic acid sequence capable of being transcribed and translated into a protein). In general, a payload nucleic acid sequence encoding a peptide can encode any protein desired to be expressed in a cell. Examples of proteins include, but are not limited to, an antigen (e.g., a MHC class I epitope, a MHC class II epitope, or an epitope capable of stimulating a B cell response), an antibody, a cytokine, a chimeric antigen receptor (CAR), a T-cell receptor, or a genome-editing system component (e.g., a nuclease used in a genome-editing system). Genome-editing systems include, but are not limited to, a CRISPR system, a zinc-finger system, a meganuclease system, or a TALEN system. The payload nucleic acid sequence can be non-coding (i.e., a nucleic acid sequence capable of being transcribed but is not translated into a protein). In general, a non-coding payload nucleic acid sequence can be any non-coding polynucleotide desired to be expressed in a cell. Examples of non-coding polynucleotides include, but are not limited to, RNA interference (RNAi) polynucleotides (e.g., antisense oligonucleotides, shRNAs, siRNAs, miRNAs etc.) or genome-editing system polynucleotide (e.g., a guide RNA [gRNA], a single-guide RNA [sgRNA], a trans-activating CRISPR [tracrRNA], and/or a CRISPR RNA [crRNA]). A payload nucleic acid sequence can encode two or more (e.g., 2, 3, 4, 5 or more) distinct polypeptides (e.g., two or more distinct epitope sequences linked together) or contain two or more distinct non-coding nucleic acid sequences (e.g., two or more distinct RNAi polynucleotides). A payload nucleic acid sequence can have a combination of polypeptide-encoding nucleic acid sequences and non-coding nucleic acid sequences.

V.A.1 Cassettes

The methods employed for the selection of one or more antigens, the cloning and construction of a "cassette" and its insertion into a viral vector are within the skill in the art given the teachings provided herein. A cassette can have one or more payload nucleic acid sequences, such as a cassette containing multiple payload nucleic acid sequences each independently operably linked to separate promoters and/or linked together using other multicistonic systems, such as 2A ribosome skipping sequence elements (e.g., E2A, P2A, F2A, or T2A sequences) or Internal Ribosome Entry Site (IRES) sequence elements. In a cassette containing more than one payload nucleic acid sequence, each payload nucleic acid sequence can contain one or more payloads, e.g., each payload nucleic acid sequence can encode two or more polypeptides or contain two or more non-coding nucleic acid sequences. A cassette can have a combination of polypeptide-encoding nucleic acid sequences and non-coding nucleic acid sequences.

A cassette can be an antigen cassette. By "antigen cassette" is meant the combination of a selected antigen or plurality of antigens and the other regulatory elements necessary to transcribe the antigen(s) and express the transcribed product. Antigen cassettes can include one or more antigens. The selected antigen or plurality of antigens can refer to distinct epitope sequences, e.g., an antigen-encoding nucleic acid sequence in the cassette can encode an epitope-encoding nucleic acid sequence (or plurality of epitope-encoding nucleic acid sequences) such that the epitopes are transcribed and expressed.

A payload nucleic acid sequence or plurality of payload nucleic acid sequences can be operatively linked to regulatory components in a manner which permits transcription. Such components include conventional regulatory elements that can drive expression of the antigen(s) in a cell transfected with the viral vector. Thus the cassette can also contain a selected promoter which is linked to the payload nucleic acid sequence(s) and located, with other, optional regulatory elements, within the selected viral sequences of the recombinant vector.

Useful promoters can be constitutive promoters or regulated (e.g., inducible) promoters, which will enable control of the amount of payload nucleic acid sequence(s), and in general the amount of a peptide (e.g., an antigen) in the case of coding payload nucleic acid sequences, to be expressed. For example, a desirable promoter is that of the cytomegalovirus immediate early promoter/enhancer [see, e.g., Boshart et al, Cell, 41:521-530 (1985)]. Another desirable promoter includes the Rous sarcoma virus LTR promoter/enhancer. Still another promoter/enhancer sequence is the chicken cytoplasmic beta-actin promoter [T. A. Kost et al, Nucl. Acids Res., 11(23):8287 (1983)]. Other suitable or desirable promoters can be selected by one of skill in the art, such as a CMV, SV40, EF-1, RSV, PGK, HSA, MCK or EBV promoter sequence.

The cassette can also include nucleic acid sequences heterologous to the viral vector sequences including sequences providing signals for efficient polyadenylation of the transcript (poly(A), poly-A or pA) and introns with functional splice donor and acceptor sites. A common poly-A sequence which is employed in the exemplary vectors of this invention is that derived from the papovavirus SV-40. The poly-A sequence generally can be inserted in the cassette following the payload nucleic acid sequences and before the viral vector sequences. A common intron sequence can also be derived from SV-40, and is referred to as the SV-40 T intron sequence. A cassette can also contain such an intron, located between the promoter/enhancer sequence and the payload nucleic acid sequence(s). Selection of these and other common vector elements are conventional [see, e.g., Sambrook et al, "Molecular Cloning. A Laboratory Manual.", 2d edit., Cold Spring Harbor Laboratory, New York (1989) and references cited therein] and many such sequences are available from commercial and industrial sources as well as from Genbank.

A cassette can have one or more payload nucleic acid sequences. For example, a given cassette can include 1-10, 1-20, 1-30, 10-20, 15-25, 15-20, 1, 2, 3, 4, 5, 6, 7, 8, 9, 10, 11, 12, 13, 14, 15, 16, 17, 18, 19, 20, or more payload nucleic acid sequences. Payload nucleic acid sequences can be linked directly to one another. Payload nucleic acid sequences can also be linked to one another with linkers.

A cassette can have one or more payload nucleic acid sequences encoding a polypeptide. For example, a given cassette can include 1-10, 1-20, 1-30, 10-20, 15-25, 15-20, 1, 2, 3, 4, 5, 6, 7, 8, 9, 10, 11, 12, 13, 14, 15, 16, 17, 18, 19, 20, or more payload nucleic acid sequences encoding a polypeptide. A cassette can have one or more payload nucleic acid sequences where each payload nucleic acid sequence encodes a distinct polypeptide. A cassette can have one or more payload nucleic acid sequences where each payload nucleic acid sequence encodes one or more polypeptides. A cassette can have one or more payload nucleic acid sequences where one or more payload nucleic acid sequences encode one or more polypeptides. Polypeptides encoded by a payload nucleic acid sequence can be in any orientation relative to one another including N to C or C to N.

An antigen cassette can have one or more antigens. For example, a given cassette can include 1-10, 1-20, 1-30, 10-20, 15-25, 15-20, 1, 2, 3, 4, 5, 6, 7, 8, 9, 10, 11, 12, 13, 14, 15, 16, 17, 18, 19, 20, or more antigens. Antigens can be linked directly to one another. Antigens can also be linked to one another with linkers. Antigens can be in any orientation relative to one another including N to C or C to N.

As above stated, the cassette can be located in the site of any selected deletion in the viral vector, such as the site of the E1 gene region deletion or E3 gene region deletion, among others which may be selected.

The cassette can be described using the following formula to describe the ordered sequence of each element, from 5' to 3':

$$(P_a\text{-}(L5_b\text{-}N_c\text{-}L3_d)_X)_Z\text{-}(P2_h\text{-}(G5_e\text{-}U_f)_Y)_W\text{-}G3_g$$

wherein P and P2 comprise promoter nucleic acid sequences, N comprises a distinct epitope-encoding nucleic acid sequence, L5 comprises a 5' linker sequence, L3 comprises a 3' linker sequence, G5 comprises a nucleic acid sequences encoding an amino acid linker, G3 comprises one of the at least one nucleic acid sequences encoding an amino acid linker, U comprises an MHC class II antigen-encoding nucleic acid sequence, where for each X the corresponding Nc is a epitope encoding nucleic acid sequence, where for each Y the corresponding Uf is an antigen-encoding nucleic acid sequence. The composition and ordered sequence can be further defined by selecting the number of elements present, for example where $a=0$ or 1, where $b=0$ or 1, where $c=1$, where $d=0$ or 1, where $e=0$ or 1, where $f=1$, where $g=0$ or 1, where $h=0$ or 1, $X=1$ to 400, $Y=0, 1, 2, 3, 4$ or 5, $Z=1$ to 400, and $W=0, 1, 2, 3, 4$ or 5.

In one example, elements present include where $a=0$, $b=1$, $d=1$, $e=1$, $g=1$, $h=0$, $X=10$, $Y=2$, $Z=1$, and $W=1$, describing where no additional promoter is present (i.e. only the promoter nucleic acid sequence provided by the RNA alphavirus backbone is present), 20 MHC class I epitope are present, a 5' linker is present for each N, a 3' linker is present for each N, 2 MHC class II epitopes are present, a linker is present linking the two MHC class II epitopes, a linker is present linking the 5' end of the two MHC class II epitopes to the 3' linker of the final MHC class I epitope, and a linker is present linking the 3' end of the two MHC class II epitopes to the to the RNA alphavirus backbone. Examples of linking the 3' end of the cassette to the RNA alphavirus backbone include linking directly to the 3' UTR elements provided by the RNA alphavirus backbone, such as a 3' 19-nt CSE. Examples of linking the 5' end of the cassette to the RNA alphavirus backbone include linking directly to a 26S promoter sequence, an alphavirus 5' UTR, a 51-nt CSE, or a 24-nt CSE.

Other examples include: where $a=1$ describing where a promoter other than the promoter nucleic acid sequence provided by the RNA alphavirus backbone is present; where $a=1$ and Z is greater than 1 where multiple promoters other than the promoter nucleic acid sequence provided by the RNA alphavirus backbone are present each driving expression of 1 or more distinct MHC class I epitope encoding nucleic acid sequences; where $h=1$ describing where a separate promoter is present to drive expression of the MHC class II antigen-encoding nucleic acid sequences; and where $g=0$ describing the MHC class II antigen-encoding nucleic acid sequence, if present, is directly linked to the RNA alphavirus backbone.

Other examples include where each MHC class I epitope that is present can have a 5' linker, a 3' linker, neither, or both. In examples where more than one MHC class I epitope is present in the same cassette, some MHC class I epitopes may have both a 5' linker and a 3' linker, while other MHC class I epitopes may have either a 5' linker, a 3' linker, or neither. In other examples where more than one MHC class I epitope is present in the same cassette, some MHC class I epitopes may have either a 5' linker or a 3' linker, while other MHC class I epitopes may have either a 5' linker, a 3' linker, or neither.

In examples where more than one MHC class II epitope is present in the same cassette, some MHC class II epitopes may have both a 5' linker and a 3' linker, while other MHC class II epitopes may have either a 5' linker, a 3' linker, or neither. In other examples where more than one MHC class II epitope is present in the same cassette, some MHC class II epitopes may have either a 5' linker or a 3' linker, while other MHC class II epitopes may have either a 5' linker, a 3' linker, or neither.

The promoter nucleic acid sequences P and/or P2 can be the same as a promoter nucleic acid sequence provided by the RNA alphavirus backbone. For example, the promoter sequence provided by the RNA alphavirus backbone, Pn and P2, can each comprise a 26S subgenomic promoter. The promoter nucleic acid sequences P and/or P2 can be different from the promoter nucleic acid sequence provided by the RNA alphavirus backbone, as well as can be different from each other.

The 5' linker L5 can be a native sequence or a non-natural sequence. Non-natural sequence include, but are not limited to, AAY, RR, and DPP. The 3' linker L3 can also be a native sequence or a non-natural sequence. Additionally, L5 and L3 can both be native sequences, both be non-natural sequences, or one can be native and the other non-natural. For each X, the amino acid linkers can be 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length. For each X, the amino acid linkers can be also be at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acids in length.

The amino acid linker G5, for each Y, can be 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length. For each Y, the amino acid linkers can be also be at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acids in length.

The amino acid linker G3 can be 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length. G3 can be also be at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acids in length.

For each X, each N can encodes a MHC class I epitope 7-15 amino acids in length. For each X, each N can also encodes a MHC class I epitope 5, 6, 7, 8, 9, 10, 11, 12, 13, 14, 15, 16, 17, 18, 19, 20, 21, 22, 23, 24, 25, 26, 27, 28, 29, or 30 amino acids in length. For each X, each N can also encodes a MHC class I epitope at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, or at least 30 amino acids in length.

The cassette encoding the payload nucleic acid sequence can be 700 nucleotides or less. The cassette encoding the payload nucleic acid sequence can be 700 nucleotides or less and encode 2 distinct epitope-encoding nucleic acid sequences. The cassette encoding the payload nucleic acid sequence can be 700 nucleotides or less and encode at least 2 distinct epitope-encoding nucleic acid sequences. The cassette encoding the payload nucleic acid sequence can be 700 nucleotides or less and encode 3 distinct epitope-encoding nucleic acid sequences. The cassette encoding the payload nucleic acid sequence can be 700 nucleotides or less and encode at least 3 distinct epitope-encoding nucleic acid sequences. The cassette encoding the payload nucleic acid sequence can be 700 nucleotides or less and include 1-10, 1-5, 1, 2, 3, 4, 5, 6, 7, 8, 9, 10, or more antigens.

The cassette encoding the payload nucleic acid sequence can be between 375-700 nucleotides in length. The cassette encoding the payload nucleic acid sequence can be between 375-700 nucleotides in length and encode 2 distinct epitope-encoding nucleic acid sequences. The cassette encoding the payload nucleic acid sequence can be between 375-700 nucleotides in length and encode at least 2 distinct epitope-encoding nucleic acid sequences. The cassette encoding the payload nucleic acid sequence can be between 375-700 nucleotides in length and encode 3 distinct epitope-encoding nucleic acid sequences. The cassette encoding the payload nucleic acid sequence can be between 375-700 nucleotides in length and encode at least 3 distinct epitope-encoding nucleic acid sequences. The cassette encoding the payload nucleic acid sequence can be between 375-700 nucleotides in length and include 1-10, 1-5, 1, 2, 3, 4, 5, 6, 7, 8, 9, 10, or more antigens.

The cassette encoding the payload nucleic acid sequence can be 600, 500, 400, 300, 200, or 100 nucleotides in length or less. The cassette encoding the payload nucleic acid sequence can be 600, 500, 400, 300, 200, or 100 nucleotides in length or less and encode 2 distinct epitope-encoding nucleic acid sequences. The cassette encoding the payload nucleic acid sequence can be 600, 500, 400, 300, 200, or 100 nucleotides in length or less and encode at least 2 distinct epitope-encoding nucleic acid sequences. The cassette encoding the payload nucleic acid sequence can be 600, 500, 400, 300, 200, or 100 nucleotides in length or less and encode 3 distinct epitope-encoding nucleic acid sequences. The cassette encoding the payload nucleic acid sequence can be 600, 500, 400, 300, 200, or 100 nucleotides in length or less and encode at least 3 distinct epitope-encoding nucleic acid sequences. The cassette encoding the payload nucleic acid sequence can be 600, 500, 400, 300, 200, or 100 nucleotides in length or less and include 1-10, 1-5, 1, 2, 3, 4, 5, 6, 7, 8, 9, 10, or more antigens.

The cassette encoding the payload nucleic acid sequence can be between 375-600, between 375-500, or between 375-400 nucleotides in length. The cassette encoding the payload nucleic acid sequence can be between 375-600, between 375-500, or between 375-400 nucleotides in length and encode 2 distinct epitope-encoding nucleic acid sequences. The cassette encoding the payload nucleic acid sequence can be between 375-600, between 375-500, or between 375-400 nucleotides in length and encode at least 2 distinct epitope-encoding nucleic acid sequences. The cassette encoding the payload nucleic acid sequence can be between 375-600, between 375-500, or between 375-400 nucleotides in length and encode 3 distinct epitope-encoding nucleic acid sequences. The cassette encoding the payload nucleic acid sequence can be between 375-600, between 375-500, or between 375-400 nucleotides in length and encode at least 3 distinct epitope-encoding nucleic acid sequences. The cassette encoding the payload nucleic acid sequence can be between 375-600, between 375-500, or between 375-400 nucleotides in length and include 1-10, 1-5, 1, 2, 3, 4, 5, 6, 7, 8, 9, 10, or more antigens.

V.A.2 TET Promoter System

Also disclosed herein is a viral vector comprising a cassette with at least one payload sequence operably linked to a regulatable promoter that is a TET promoter system, such as a TET-On system or TET-Off system. Without wishing to be bound by theory, a TET promoter system can be used to minimize transcription of payload nucleic acids encoded in a cassette, such as antigens encoded in a vaccine cassette, during viral production. A TET promoter system can include a tetracycline (TET) repressor protein (TETr) controlled promoter. Accordingly, also disclosed herein is a viral vector comprising a cassette with at least one payload sequence operably linked to a tetracycline (TET) repressor protein (TETr) controlled promoter. TETr sequences (tTS) can include the amino acid sequence shown in a SEQ ID NO:63 and/or encoded by the nucleotide sequence shown in SEQ ID NO:62. A TETr controlled promoter can include the 19 bp TET operator (TETo) sequence TCCCTATCAGTGA-TAGAGA (SEQ ID NO:60). A TETr controlled promoter can include 2, 3, 4, 5, 6, 7, 8, 9, or 10 or more TETo nucleic acid sequences. In TETr controlled promoter have 2 or more TETo nucleic acid sequences, the TETo sequences can be linked together. In TETr controlled promoter have 2 or more TETo nucleic acid sequences, the TETo sequences can be directly linked together. In TETr controlled promoter have 2 or more TETo nucleic acid sequences, the TETo sequences can be linked together with a linker sequence, such as a linker sequence having 1, 2, 3, 4, 5, 6, 7, 8, 9, 10, 11, 12, 13, 14, 15, 16, 17, 18, 19, or 20 or more nucleotides. In one example, the linker sequence has the linker nucleotide sequence shown in SEQ ID NO:61. In general, a TETr controlled promoter can use any promoter sequence desired, such as a SV40, EF-1, RSV, PGK, HSA, MCK or EBV promoter sequence. A TETr controlled promoter can use a CMV promoter sequence. A TETr controlled promoter can use a minimal CMV promoter sequence. TETo sequences can be upstream (5') of a promoter sequence region where RNA polymerase binds. In an illustrative example, 7 TETo sequences are upstream (5') of a promoter sequence. A TETr controlled promoter operably linked to the at least one payload nucleic acid sequence with TETo sequence upstream of the promoter sequence region can have an ordered sequence described in the formula, from 5' to 3':

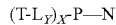

where N is a payload nucleic acid sequence, P is a RNA polymerase binding sequence of the promoter sequence operably linked to payload nucleic acid sequence, T is a TETo nucleic acid sequences comprising the nucleotide sequence shown in SEQ ID NO:60, L is a linker sequence, where Y=0 or 1 for each X, and wherein X=1, 2, 3, 4, 5, 6, 7, 8, 9, 10, 11, 12, 13, 14, 15, 16, 17, 18, 19, or 20. In an illustrative example, X=7 and Y=1 for each X describes where 7 TETo sequences are upstream (5') of the promoter sequence and each TETo sequence is separated by a linker.

A TETo sequences can be downstream (3') of a promoter sequence region where RNA polymerase binds. In another illustrative example, 2 TETo sequences are downstream (3') of a promoter sequence. A TETr controlled promoter operably linked to the at least one payload nucleic acid sequence with TETo sequence downstream of the promoter sequence region can have an ordered sequence described in the formula, from 5' to 3':

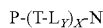

where N is a payload nucleic acid sequence, P is a RNA polymerase binding sequence of the promoter sequence operably linked to payload nucleic acid sequence, T is a TETo nucleic acid sequences comprising the nucleotide sequence shown in SEQ ID NO:60, L is a linker sequence, where Y=0 or 1 for each X, and wherein X=1, 2, 3, 4, 5, 6, 7, 8, 9, 10, 11, 12, 13, 14, 15, 16, 17, 18, 19, or 20. In an illustrative example, X=2 and Y=1 for each X describes where 2 TETo sequences are downstream (3') of the promoter sequence and each TETo sequence is separated by a linker.

Viral production of vectors with TETr controlled promoters can use any viral production cell line engineered to express a TETr sequence (tTS), such as a 293 cell line or its derivatives (e.g., a 293F cell line) engineered to express tTS. Viral production of vectors with TETr controlled promoters in tTS-expressing cell can improve viral production. Viral production of vectors with TETr controlled promoters in tTS-expressing cell can improve viral infectivity defined as viral particles (VP) per infectious unit (IU). Viral production of vectors with TETr controlled promoters in tTS-expressing cell can improve viral production and/or viral infectivity by at least 1.5, at least 2, at least 2.5, at least 3, at least 3.5, at least 4, at least 4.5, at least 5, at least 6, at least 7, at least 8, at least 9, or at least 10-fold relative to production in a non-tTS-expressing cell. Viral production of vectors with TETr controlled promoters in tTS-expressing cell can improve viral production and/or viral infectivity by at least 15, at least 20, at least 25, at least 30, at least 35, at least 40, at least 45, at least 50, at least 60, at least 70, at least 80, at least 90, or at least 100-fold relative to production in a non-tTS-expressing cell. Viral production of vectors with TETr controlled promoters in tTS-expressing cell can improve viral production and/or viral infectivity by at least 1.5, at least 2, at least 2.5, at least 3, at least 3.5, at least 4, at least 4.5, at least 5, at least 6, at least 7, at least 8, at least 9, or at least 10-fold relative to production of a vector not having a TETr controlled promoter. Viral production of vectors with TETr controlled promoters in tTS-expressing cell can improve viral production and/or viral infectivity by at least 15, at least 20, at least 25, at least 30, at least 35, at least 40, at least 45, at least 50, at least 60, at least 70, at least 80, at least 90, or at least 100-fold relative to production of a vector not having a TETr controlled promoter.

V.B. Immune Checkpoints

Vectors described herein, such as C68 vectors described herein or alphavirus vectors described herein, can comprise a nucleic acid which encodes at least one antigen and the same or a separate vector can comprise a nucleic acid which encodes at least one immune modulator (e.g., an antibody such as an scFv) which binds to and blocks the activity of an immune checkpoint molecule. Vectors can comprise a cassette and one or more nucleic acid molecules encoding a checkpoint inhibitor.

Illustrative immune checkpoint molecules that can be targeted for blocking or inhibition include, but are not limited to, CTLA-4, 4-1BB (CD137), 4-1BBL (CD137L), PDL1, PDL2, PD1, B7-H3, B7-H4, BTLA, HVEM, TIM3, GAL9, LAG3, TIM3, B7H3, B7H4, VISTA, KIR, 2B4 (belongs to the CD2 family of molecules and is expressed on all NK, □□, and memory CD8+ (□□) T cells), CD160 (also referred to as BY55), and CGEN-15049. Immune checkpoint inhibitors include antibodies, or antigen binding fragments thereof, or other binding proteins, that bind to and block or inhibit the activity of one or more of CTLA-4, PDL1, PDL2, PD1, B7-H3, B7-H4, BTLA, HVEM, TIM3, GAL9, LAG3, TIM3, B7H3, B7H4, VISTA, KIR, 2B4, CD160, and CGEN-15049. Illustrative immune checkpoint inhibitors include Tremelimumab (CTLA-4 blocking antibody), anti-OX40, PD-L1 monoclonal Antibody (Anti-B7-H1; MEDI4736), ipilimumab, MK-3475 (PD-1 blocker), Nivolumamb (anti-PD1 antibody), CT-011 (anti-PD1 antibody), BY55 monoclonal antibody, AMP224 (anti-PDL1 antibody), BMS-936559 (anti-PDL1 antibody), MPLDL3280A (anti-PDL1 antibody), MSB0010718C (anti-PDL1 antibody) and Yervoy/ipilimumab (anti-CTLA-4 checkpoint inhibitor). Antibody-encoding sequences can be engineered into vectors such as C68 using ordinary skill in the art. An exemplary method is described in Fang et al., Stable antibody expression at therapeutic levels using the 2A peptide. Nat Biotechnol. 2005 May; 23(5):584-90. Epub 2005 Apr. 17; herein incorporated by reference for all purposes.

V.C. Additional Considerations for Vaccine Design and Manufacture

V.C.1. Determination of a Set of Peptides that Cover all Tumor Subclones

Truncal peptides, meaning those presented by all or most tumor subclones, can be prioritized for inclusion into the vaccine.[53] Optionally, if there are no truncal peptides predicted to be presented and immunogenic with high probability, or if the number of truncal peptides predicted to be presented and immunogenic with high probability is small enough that additional non-truncal peptides can be included in the vaccine, then further peptides can be prioritized by estimating the number and identity of tumor subclones and choosing peptides so as to maximize the number of tumor subclones covered by the vaccine.[54]

V.C.2. Antigen Prioritization

After all of the above antigen filters are applied, more candidate antigens may still be available for vaccine inclusion than the vaccine technology can support. Additionally, uncertainty about various aspects of the antigen analysis may remain and tradeoffs may exist between different properties of candidate vaccine antigens. Thus, in place of predetermined filters at each step of the selection process, an integrated multi-dimensional model can be considered that places candidate antigens in a space with at least the following axes and optimizes selection using an integrative approach.
1. Risk of auto-immunity or tolerance (risk of germline) (lower risk of auto-immunity is typically preferred)
2. Probability of sequencing artifact (lower probability of artifact is typically preferred)
3. Probability of immunogenicity (higher probability of immunogenicity is typically preferred)
4. Probability of presentation (higher probability of presentation is typically preferred)
5. Gene expression (higher expression is typically preferred)
6. Coverage of HLA genes (larger number of HLA molecules involved in the presentation of a set of antigens may lower the probability that a tumor will escape immune attack via downregulation or mutation of HLA molecules)
7. Coverage of HLA classes (covering both HLA-I and HLA-II may increase the probability of therapeutic response and decrease the probability of tumor escape)

Additionally, optionally, antigens can be deprioritized (e.g., excluded) from the vaccination if they are predicted to be presented by HLA alleles lost or inactivated in either all or part of the patient's tumor or infected cell. HLA allele loss can occur by either somatic mutation, loss of heterozygosity, or homozygous deletion of the locus. Methods for detection of HLA allele somatic mutation are well known in the art, e.g. (Shukla et al., 2015). Methods for detection of somatic LOH and homozygous deletion (including for HLA locus) are likewise well described. (Carter et al., 2012; McGranahan et al., 2017; Van Loo et al., 2010). Antigens can also be deprioritized if mass-spectrometry data indicates a predicted antigen is not presented by a predicted HLA allele.

V.D. Alphavirus

V.D.1. Alphavirus Biology

Alphaviruses are members of the family Togaviridae, and are positive-sense single stranded RNA viruses. Members are typically classified as either Old World, such as Sindbis, Ross River, Mayaro, Chikungunya, and Semliki Forest viruses, or New World, such as eastern equine encephalitis, Aura, Fort Morgan, or Venezuelan equine encephalitis virus and its derivative strain TC-83 (Strauss Microbrial Review 1994). A natural alphavirus genome is typically around 12 kb in length, the first two-thirds of which contain genes encoding non-structural proteins (nsPs) that form RNA replication complexes for self-replication of the viral genome, and the last third of which contains a subgenomic expression cassette encoding structural proteins for virion production (Frolov RNA 2001).

A model lifecycle of an alphavirus involves several distinct steps (Strauss Microbrial Review 1994, Jose Future Microbiol 2009). Following virus attachment to a host cell, the virion fuses with membranes within endocytic compartments resulting in the eventual release of genomic RNA into the cytosol. The genomic RNA, which is in a plus-strand orientation and comprises a 5' methylguanylate cap and 3' polyA tail, is translated to produce non-structural proteins nsP1-4 that form the replication complex. Early in infection, the plus-strand is then replicated by the complex into a minus-stand template. In the current model, the replication complex is further processed as infection progresses, with the resulting processed complex switching to transcription of the minus-strand into both full-length positive-strand genomic RNA, as well as the 26S subgenomic positive-strand RNA containing the structural genes. Several conserved sequence elements (CSEs) of alphavirus have been identified to potentially play a role in the various RNA replication steps including; a complement of the 5' UTR in the replication of plus-strand RNAs from a minus-strand template, a 51-nt CSE in the replication of minus-strand synthesis from the genomic template, a 24-nt CSE in the junction region between the nsPs and the 26S RNA in the transcription of the subgenomic RNA from the minus-strand, and a 3' 19-nt CSE in minus-strand synthesis from the plus-strand template.

Following the replication of the various RNA species, virus particles are then typically assembled in the natural lifecycle of the virus. The 26S RNA is translated and the resulting proteins further processed to produce the structural proteins including capsid protein, glycoproteins E1 and E2, and two small polypeptides E3 and 6K (Strauss 1994). Encapsidation of viral RNA occurs, with capsid proteins normally specific for only genomic RNA being packaged, followed by virion assembly and budding at the membrane surface.

V.D.2. Alphavirus as a Delivery Vector

Alphaviruses (including alphavirus sequences, features, and other elements) can be used to generate alphavirus-based delivery vectors (also be referred to as alphavirus vectors, alphavirus viral vectors, alphavirus vaccine vectors, self-replicating RNA (srRNA) vectors, or self-amplifying RNA (samRNA) vectors). Alphaviruses have previously been engineered for use as expression vector systems (Pushko 1997, Rheme 2004). Alphaviruses offer several advantages, particularly in a vaccine setting where heterologous antigen expression can be desired. Due to its ability to self-replicate in the host cytosol, alphavirus vectors are generally able to produce high copy numbers of the expression cassette within a cell resulting in a high level of heterologous antigen production. Additionally, the vectors are generally transient, resulting in improved biosafety as well as reduced induction of immunological tolerance to the vector. The public, in general, also lacks pre-existing immunity to alphavirus vectors as compared to other standard viral vectors, such as human adenovirus. Alphavirus based vectors also generally result in cytotoxic responses to infected cells. Cytotoxicity, to a certain degree, can be important in a vaccine setting to properly illicit an immune response to the heterologous antigen expressed. However, the degree of desired cytotoxicity can be a balancing act, and thus several attenuated alphaviruses have been developed, including the TC-83 strain of VEE. Thus, an example of an antigen expression vector described herein can utilize an alphavirus backbone that allows for a high level of antigen expression, elicits a robust immune response to antigen, does not elicit an immune response to the vector itself, and can be used in a safe manner. Furthermore, the antigen expression cassette can be designed to elicit different levels of an immune response through optimization of which alphavirus sequences the vector uses, including, but not limited to, sequences derived from VEE or its attenuated derivative TC-83.

Several expression vector design strategies have been engineered using alphavirus sequences (Pushko 1997). In one strategy, a alphavirus vector design includes inserting a second copy of the 26S promoter sequence elements downstream of the structural protein genes, followed by a heterologous gene (Frolov 1993). Thus, in addition to the natural non-structural and structural proteins, an additional subgenomic RNA is produced that expresses the heterologous protein. In this system, all the elements for production of infectious virions are present and, therefore, repeated rounds of infection of the expression vector in non-infected cells can occur.

Another expression vector design makes use of helper virus systems (Pushko 1997). In this strategy, the structural proteins are replaced by a heterologous gene. Thus, following self-replication of viral RNA mediated by still intact non-structural genes, the 26S subgenomic RNA provides for expression of the heterologous protein. Traditionally, additional vectors that expresses the structural proteins are then supplied in trans, such as by co-transfection of a cell line, to produce infectious virus. A system is described in detail in U.S. Pat. No. 8,093,021, which is herein incorporated by reference in its entirety, for all purposes. The helper vector system provides the benefit of limiting the possibility of forming infectious particles and, therefore, improves biosafety. In addition, the helper vector system reduces the total vector length, potentially improving the replication and expression efficiency. Thus, an example of an antigen expression vector described herein can utilize an alphavirus backbone wherein the structural proteins are replaced by a cassette, the resulting vector both reducing biosafety concerns, while at the same time promoting efficient expression due to the reduction in overall expression vector size.

V.D.3. Alphavirus Production In Vitro

Alphavirus delivery vectors are generally positive-sense RNA polynucleotides. A convenient technique well-known in the art for RNA production is in vitro transcription IVT. In this technique, a DNA template of the desired vector is first produced by techniques well-known to those in the art, including standard molecular biology techniques such as cloning, restriction digestion, ligation, gene synthesis, and polymerase chain reaction (PCR). The DNA template contains a RNA polymerase promoter at the 5' end of the sequence desired to be transcribed into RNA. Promoters include, but are not limited to, bacteriophage polymerase promoters such as T3, T7, or SP6. The DNA template is then incubated with the appropriate RNA polymerase enzyme, buffer agents, and nucleotides (NTPs). The resulting RNA polynucleotide can optionally be further modified including, but limited to, addition of a 5' cap structure such as 7-methylguanosine or a related structure, and optionally modifying the 3' end to include a polyadenylate (polyA) tail. The RNA can then be purified using techniques well-known in the field, such as phenol-chloroform extraction.

V.D.4. Delivery Via Lipid Nanoparticle

An important aspect to consider in vaccine vector design is immunity against the vector itself (Riley 2017). This may be in the form of preexisting immunity to the vector itself, such as with certain human adenovirus systems, or in the form of developing immunity to the vector following administration of the vaccine. The latter is an important consideration if multiple administrations of the same vaccine are performed, such as separate priming and boosting doses, or if the same vaccine vector system is to be used to deliver different cassettes.

In the case of alphavirus vectors, the standard delivery method is the previously discussed helper virus system that provides capsid, E1, and E2 proteins in trans to produce infectious viral particles. However, it is important to note that the E1 and E2 proteins are often major targets of neutralizing antibodies (Strauss 1994). Thus, the efficacy of using alphavirus vectors to deliver antigens of interest to target cells may be reduced if infectious particles are targeted by neutralizing antibodies.

An alternative to viral particle mediated gene delivery is the use of nanomaterials to deliver expression vectors (Riley 2017). Nanomaterial vehicles, importantly, can be made of non-immunogenic materials and generally avoid eliciting immunity to the delivery vector itself. These materials can include, but are not limited to, lipids, inorganic nanomaterials, and other polymeric materials. Lipids can be cationic, anionic, or neutral. The materials can be synthetic or naturally derived, and in some instances biodegradable. Lipids can include fats, cholesterol, phospholipids, lipid conjugates including, but not limited to, polyethyleneglycol (PEG) conjugates (PEGylated lipids), waxes, oils, glycerides, and fat soluable vitamins.

Lipid nanoparticles (LNPs) are an attractive delivery system due to the amphiphilic nature of lipids enabling formation of membranes and vesicle like structures (Riley 2017). In general, these vesicles deliver the expression vector by absorbing into the membrane of target cells and releasing nucleic acid into the cytosol. In addition, LNPs can be further modified or functionalized to facilitate targeting of specific cell types. Another consideration in LNP design is the balance between targeting efficiency and cytotoxicity. Lipid compositions generally include defined mixtures of cationic, neutral, anionic, and amphipathic lipids. In some instances, specific lipids are included to prevent LNP aggregation, prevent lipid oxidation, or provide functional chemical groups that facilitate attachment of additional moieties. Lipid composition can influence overall LNP size and stability. In an example, the lipid composition comprises dilinoleylmethyl-4-dimethylaminobutyrate (MC3) or MC3-like molecules. MC3 and MC3-like lipid compositions can be formulated to include one or more other lipids, such as a PEG or PEG-conjugated lipid, a sterol, or neutral lipids.

Nucleic-acid vectors, such as expression vectors, exposed directly to serum can have several undesirable consequences, including degradation of the nucleic acid by serum nucleases or off-target stimulation of the immune system by the free nucleic acids. Therefore, encapsulation of the alphavirus vector can be used to avoid degradation, while also avoiding potential off-target affects. In certain examples, an alphavirus vector is fully encapsulated within the delivery vehicle, such as within the aqueous interior of an LNP. Encapsulation of the alphavirus vector within an LNP can be carried out by techniques well-known to those skilled in the art, such as microfluidic mixing and droplet generation carried out on a microfluidic droplet generating device. Such devices include, but are not limited to, standard T-junction devices or flow-focusing devices. In an example, the desired lipid formulation, such as MC3 or MC3-like containing compositions, is provided to the droplet generating device in parallel with the alphavirus delivery vector and other desired agents, such that the delivery vector and desired agents are fully encapsulated within the interior of the MC3 or MC3-like based LNP. In an example, the droplet generating device can control the size range and size distribution of the LNPs produced. For example, the LNP can have a size ranging from 1 to 1000 nanometers in diameter, e.g., 1, 10, 50, 100, 500, or 1000 nanometers. Following droplet generation, the delivery vehicles encapsulating the expression vectors can be further treated or modified to prepare them for administration.

V.E. Chimpanzee Adenovirus (ChAd)

V.E.1. Viral Delivery with Chimpanzee Adenovirus

Vaccine compositions for delivery of one or more antigens (e.g., via a cassette encoding one or more antigens or neoantigens) can be created by providing adenovirus nucleic acid sequences of chimpanzee origin, a variety of novel vectors, and cell lines expressing chimpanzee adenovirus genes. A nucleic acid sequence of a chimpanzee C68 adenovirus (also referred to herein as ChAdV68) can be used in a vaccine composition for antigen delivery (See SEQ ID NO: 1). Use of C68 adenovirus derived vectors is described in further detail in U.S. Pat. No. 6,083,716, which is herein incorporated by reference in its entirety, for all purposes.

In a further aspect, provided herein is a recombinant adenovirus comprising the DNA sequence of a chimpanzee adenovirus such as C68 and a cassette operatively linked to regulatory sequences directing its expression. The recombinant virus is capable of infecting a mammalian, preferably a human, cell and capable of expressing the cassette payload in the cell. In this vector, the native chimpanzee E1 gene, and/or E3 gene, and/or E4 gene can be deleted. A cassette can be inserted into any of these sites of gene deletion. The cassette can include an antigen against which a primed immune response is desired.

In another aspect, provided herein is a mammalian cell infected with a chimpanzee adenovirus such as C68.

In still a further aspect, a novel mammalian cell line is provided which expresses a chimpanzee adenovirus gene (e.g., from C68) or functional fragment thereof.

In still a further aspect, provided herein is a method for delivering a cassette into a mammalian cell comprising the step of introducing into the cell an effective amount of a chimpanzee adenovirus, such as C68, that has been engineered to express the cassette.

Still another aspect provides a method for eliciting an immune response in a mammalian host to treat cancer. The method can comprise the step of administering to the host an effective amount of a recombinant chimpanzee adenovirus, such as C68, comprising a cassette that encodes one or more antigens from the tumor against which the immune response is targeted.

Still another aspect provides a method for eliciting an immune response in a mammalian host to treat or prevent a disease in a subject, such as an infectious disease. The method can comprise the step of administering to the host an effective amount of a recombinant chimpanzee adenovirus, such as C68, comprising an antigen cassette that encodes one or more antigens, such as from the infectious disease against which the immune response is targeted.

Also disclosed is a non-simian mammalian cell that expresses a chimpanzee adenovirus gene obtained from the sequence of SEQ ID NO: 1. The gene can be selected from the group consisting of the adenovirus E1A, E1B, E2A, E2B, E3, E4, L1, L2, L3, L4 and L5 of SEQ ID NO: 1.

Also disclosed is a nucleic acid molecule comprising a chimpanzee adenovirus DNA sequence comprising a gene obtained from the sequence of SEQ ID NO: 1. The gene can be selected from the group consisting of said chimpanzee adenovirus E1A, E1B, E2A, E2B, E3, E4, L1, L2, L3, L4 and L5 genes of SEQ ID NO: 1. In some aspects the nucleic acid molecule comprises SEQ ID NO: 1. In some aspects the nucleic acid molecule comprises the sequence of SEQ ID NO: 1, lacking at least one gene selected from the group consisting of E1A, E1B, E2A, E2B, E3, E4, L1, L2, L3, L4 and L5 genes of SEQ ID NO: 1.

Also disclosed is a vector comprising a chimpanzee adenovirus DNA sequence obtained from SEQ ID NO: 1 and a cassette operatively linked to one or more regulatory sequences which direct expression of the cassette in a heterologous host cell, optionally wherein the chimpanzee adenovirus DNA sequence comprises at least the cis-elements necessary for replication and virion encapsidation, the cis-elements flanking the cassette and regulatory sequences. In some aspects, the chimpanzee adenovirus DNA sequence comprises a gene selected from the group consisting of E1A, E1B, E2A, E2B, E3, E4, L1, L2, L3, L4 and L5 gene sequences of SEQ ID NO: 1. In some aspects the vector can lack the E1A and/or E1B gene.

Also disclosed herein is a host cell transfected with a vector disclosed herein such as a C68 vector engineered to expression a cassette. Also disclosed herein is a human cell that expresses a selected gene introduced therein through introduction of a vector disclosed herein into the cell.

Also disclosed herein is a adenovirus vector comprising: a partially deleted E4 gene comprising a deleted or partially-deleted E4orf2 region and a deleted or partially-deleted E4orf3 region, and optionally a deleted or partially-deleted E4orf4 region. The partially deleted E4 can comprise an E4 deletion of at least nucleotides 34,916 to 35,642 of the sequence shown in SEQ ID NO:1, and wherein the vector comprises at least nucleotides 2 to 36,518 of the sequence set forth in SEQ ID NO:1. The partially deleted E4 can comprise an E4 deletion of at least a partial deletion of nucleotides 34,916 to 34,942 of the sequence shown in SEQ ID NO:1, at least a partial deletion of nucleotides 34,952 to 35,305 of the sequence shown in SEQ ID NO:1, and at least a partial deletion of nucleotides 35,302 to 35,642 of the sequence shown in SEQ ID NO:1, and wherein the vector comprises at least nucleotides 2 to 36,518 of the sequence set forth in SEQ ID NO:1 The partially deleted E4 can comprise an E4 deletion of at least nucleotides 34,980 to 36,516 of the sequence shown in SEQ ID NO:1, and wherein the vector comprises at least nucleotides 2 to 36,518 of the sequence set forth in SEQ ID NO:1. The partially deleted E4 can comprise an E4 deletion of at least nucleotides 34,979 to 35,642 of the sequence shown in SEQ ID NO:1, and wherein the vector comprises at least nucleotides 2 to 36,518 of the sequence set forth in SEQ ID NO:1. The partially deleted E4 can comprise an E4 deletion of at least a partial deletion of E4Orf2, a fully deleted E4Orf3, and at least a partial deletion of E4Orf4. The partially deleted E4 can comprise an E4 deletion of at least a partial deletion of E4Orf2, at least a partial deletion of E4Orf3, and at least a partial deletion of E4Orf4. The partially deleted E4 can comprise an E4 deletion of at least a partial deletion of E4Orf1, a fully deleted E4Orf2, and at least a partial deletion of E4Orf3. The partially deleted E4 can comprise an E4 deletion of at least a partial deletion of E4Orf2 and at least a partial deletion of E4Orf3. The partially deleted E4 can comprise an E4 deletion between the start site of E4Orf1 to the start site of E4Orf5. The partially deleted E4 can be an E4 deletion adjacent to the start site of E4Orf1. The partially deleted E4 can be an E4 deletion adjacent to the start site of E4Orf2. The partially deleted E4 can be an E4 deletion adjacent to the start site of E4Orf3. The partially deleted E4 can be an E4 deletion adjacent to the start site of E4Orf4. The E4 deletion can be at least 50, at least 100, at least 200, at least 300, at least 400, at least 500, at least 600, at least 700, at least 800, at least 900, at least 1000, at least 1100, at least 1200, at least 1300, at least 1400, at least 1500, at least 1600, at least 1700, at least 1800, at least 1900, or at least 2000 nucleotides. The E4 deletion can be at least 700 nucleotides. The E4 deletion can be at least 1500 nucleotides. The E4 deletion can be 50 or less, 100 or less, 200 or less, 300 or less, 400 or less, 500 or less, 600 or less, 700 or less, 800 or less, 900 or less, 1000 or less, 1100 or less, 1200 or less, 1300 or less, 1400 or less, 1500 or less, 1600 or less, 1700 or less, 1800 or less, 1900 or less, or 2000 or less nucleotides. The E4 deletion can be 750 nucleotides or less. The E4 deletion can be at least 1550 nucleotides or less.

The partially deleted E4 gene can be the E4 gene sequence shown in SEQ ID NO:1 that lacks at least nucleotides 34,916 to 35,642 of the sequence shown in SEQ ID NO:1. The partially deleted E4 gene can be the E4 gene sequence shown in SEQ ID NO:1 that lacks the E4 gene sequence shown in SEQ ID NO:1 and that lacks at least nucleotides 34,916 to 34,942, nucleotides 34,952 to 35,305 of the sequence shown in SEQ ID NO:1, and nucleotides 35,302 to 35,642 of the sequence shown in SEQ ID NO:1. The partially deleted E4 gene can be the E4 gene sequence shown in SEQ ID NO:1 and that lacks at least nucleotides 34,980 to 36,516 of the sequence shown in SEQ ID NO:1. The partially deleted E4 gene can be the E4 gene sequence shown in SEQ ID NO:1 and that lacks at least nucleotides 34,979 to 35,642 of the sequence shown in SEQ ID NO:1. The adenovirus vector having the partially deleted E4 gene can have a cassette, wherein the cassette comprises at least one payload nucleic acid sequence, and wherein the cassette comprises at least one promoter sequence operably linked to the at least one payload nucleic acid sequence. The adenovirus vector having the partially deleted E4 gene can have one or more genes or regulatory sequences of the ChAdV68 sequence shown in SEQ ID NO: 1, optionally wherein the one or more genes or regulatory sequences comprise at least one of the chimpanzee adenovirus inverted terminal repeat (ITR), E1A, E1B, E2A, E2B, E3, E4, L1, L2, L3, L4, and L5 genes of the sequence shown in SEQ ID NO: 1. The adenovirus vector having the partially deleted E4 gene can have nucleotides 2 to 34,916 of the sequence shown in SEQ ID NO:1, wherein the partially deleted E4 gene is 3' of the nucleotides 2 to 34,916, and optionally the nucleotides 2 to 34,916 additionally lack nucleotides 577 to 3403 of the sequence shown in SEQ ID NO:1 corresponding to an E1 deletion and/or lack nucleotides 27,125 to 31,825 of the sequence shown in SEQ ID NO:1 corresponding to an E3 deletion. The adenovirus vector having the partially deleted E4 gene can have nucleotides 35,643 to 36,518 of the sequence shown in SEQ ID NO:1, and wherein the partially deleted E4 gene is 5' of the nucleotides 35,643 to 36,518. The adenovirus vector having the partially deleted E4 gene can have nucleotides 2 to 34,916 of the sequence shown in SEQ ID NO:1, wherein the partially deleted E4 gene is 3' of the nucleotides 2 to 34,916, the nucleotides 2 to 34,916 additionally lack nucleotides 577 to 3403 of the sequence shown in SEQ ID NO:1 corresponding to an E1 deletion and lack nucleotides 27,125 to 31,825 of the sequence shown in SEQ ID NO:1 corresponding to an E3 deletion. The adenovirus vector having the partially deleted E4 gene can have nucleotides 2 to 34,916 of the sequence shown in SEQ ID NO:1, wherein the partially deleted E4 gene is 3' of the nucleotides 2 to 34,916, the nucleotides 2 to 34,916 additionally lack nucleotides 577 to 3403 of the sequence shown in SEQ ID NO:1 corresponding to an E1 deletion and lack nucleotides 27,125 to 31,825 of the sequence shown in SEQ ID NO:1 corresponding to an E3 deletion, and have nucleotides 35,643 to 36,518 of the sequence shown in SEQ ID NO:1, and wherein the partially deleted E4 gene is 5' of the nucleotides 35,643 to 36,518.

The partially deleted E4 gene can be the E4 gene sequence shown in SEQ ID NO:1 that lacks at least nucleotides 34,916 to 35,642 of the sequence shown in SEQ ID NO:1, nucleotides 2 to 34,916 of the sequence shown in SEQ ID NO:1, wherein the partially deleted E4 gene is 3' of the nucleotides 2 to 34,916, the nucleotides 2 to 34,916 additionally lack nucleotides 577 to 3403 of the sequence shown in SEQ ID NO:1 corresponding to an E1 deletion and lack nucleotides 27,125 to 31,825 of the sequence shown in SEQ ID NO:1 corresponding to an E3 deletion, and have nucleotides 35,643 to 36,518 of the sequence shown in SEQ ID NO:1, and wherein the partially deleted E4 gene is 5' of the nucleotides 35,643 to 36,518.

The adenovirus vector having the partially deleted E4 gene can have

Also disclosed herein is a method for delivering a cassette to a mammalian cell comprising introducing into said cell an effective amount of a vector disclosed herein such as a C68 vector engineered to expression the cassette.

Also disclosed herein is a method for producing a comprising introducing a vector disclosed herein into a mammalian cell, culturing the cell under suitable conditions and producing the antigen.

V.E.2. E1-Expressing Complementation Cell Lines

To generate recombinant chimpanzee adenoviruses (Ad) deleted in any of the genes described herein, the function of the deleted gene region, if essential to the replication and infectivity of the virus, can be supplied to the recombinant virus by a helper virus or cell line, i.e., a complementation or packaging cell line. For example, to generate a replication-defective chimpanzee adenovirus vector, a cell line can be used which expresses the E1 gene products of the human or chimpanzee adenovirus; such a cell line can include HEK293 or variants thereof. The protocol for the generation of the cell lines expressing the chimpanzee E1 gene products (Examples 3 and 4 of U.S. Pat. No. 6,083,716) can be followed to generate a cell line which expresses any selected chimpanzee adenovirus gene.

An AAV augmentation assay can be used to identify a chimpanzee adenovirus E1-expressing cell line. This assay is useful to identify E1 function in cell lines made by using the E1 genes of other uncharacterized adenoviruses, e.g., from other species. That assay is described in Example 4B of U.S. Pat. No. 6,083,716.

A selected chimpanzee adenovirus gene, e.g., E1, can be under the transcriptional control of a promoter for expression in a selected parent cell line. Inducible or constitutive promoters can be employed for this purpose. Among inducible promoters are included the sheep metallothionine promoter, inducible by zinc, or the mouse mammary tumor virus (MMTV) promoter, inducible by a glucocorticoid, particularly, dexamethasone. Other inducible promoters, such as those identified in International patent application WO95/13392, incorporated by reference herein can also be used in the production of packaging cell lines. Constitutive promoters in control of the expression of the chimpanzee adenovirus gene can be employed also.

A parent cell can be selected for the generation of a novel cell line expressing any desired C68 gene. Without limitation, such a parent cell line can be HeLa [ATCC Accession No. CCL 2], A549 [ATCC Accession No. CCL 185], KB [CCL 17], Detroit [e.g., Detroit 510, CCL 72] and WI-38 [CCL 75] cells. Other suitable parent cell lines can be obtained from other sources. Parent cell lines can include CHO, HEK293 or variants thereof, 911, HeLa, A549, LP-293, PER.C6, or AE1-2a.

An E1-expressing cell line can be useful in the generation of recombinant chimpanzee adenovirus E1 deleted vectors. Cell lines constructed using essentially the same procedures that express one or more other chimpanzee adenoviral gene products are useful in the generation of recombinant chimpanzee adenovirus vectors deleted in the genes that encode those products. Further, cell lines which express other human Ad E1 gene products are also useful in generating chimpanzee recombinant Ads.

V.E.3. Recombinant Viral Particles as Vectors

The compositions disclosed herein can comprise viral vectors, that deliver at least one antigen to cells. Such vectors comprise a chimpanzee adenovirus DNA sequence such as C68 and a cassette operatively linked to regulatory sequences which direct expression of the cassette. The C68 vector is capable of expressing the cassette in an infected mammalian cell. The C68 vector can be functionally deleted in one or more viral genes. A cassette comprises at least one antigen under the control of one or more regulatory sequences such as a promoter. Optional helper viruses and/or packaging cell lines can supply to the chimpanzee viral vector any necessary products of deleted adenoviral genes.

The term "functionally deleted" means that a sufficient amount of the gene region is removed or otherwise altered, e.g., by mutation or modification, so that the gene region is no longer capable of producing one or more functional products of gene expression. Mutations or modifications that can result in functional deletions include, but are not limited to, nonsense mutations such as introduction of premature stop codons and removal of canonical and non-canonical start codons, mutations that alter mRNA splicing or other transcriptional processing, or combinations thereof. If desired, the entire gene region can be removed.

Modifications of the nucleic acid sequences forming the vectors disclosed herein, including sequence deletions, insertions, and other mutations may be generated using standard molecular biological techniques and are within the scope of this invention.

V.E.4. Construction of the Viral Plasmid Vector

The chimpanzee adenovirus C68 vectors useful in this invention include recombinant, defective adenoviruses, that is, chimpanzee adenovirus sequences functionally deleted in the E1a or E1b genes, and optionally bearing other mutations, e.g., temperature-sensitive mutations or deletions in other genes. It is anticipated that these chimpanzee sequences are also useful in forming hybrid vectors from other adenovirus and/or adeno-associated virus sequences. Homologous adenovirus vectors prepared from human adenoviruses are described in the published literature [see, for example, Kozarsky I and II, cited above, and references cited therein, U.S. Pat. No. 5,240,846].

In the construction of useful chimpanzee adenovirus C68 vectors for delivery of a cassette to a human (or other mammalian) cell, a range of adenovirus nucleic acid sequences can be employed in the vectors. A vector comprising minimal chimpanzee C68 adenovirus sequences can be used in conjunction with a helper virus to produce an infectious recombinant virus particle. The helper virus provides essential gene products required for viral infectivity and propagation of the minimal chimpanzee adenoviral vector. When only one or more selected deletions of chimpanzee adenovirus genes are made in an otherwise functional viral vector, the deleted gene products can be supplied in the viral vector production process by propagating the virus in a selected packaging cell line that provides the deleted gene functions in trans.

V.E.5. Recombinant Minimal Adenovirus

A minimal chimpanzee Ad C68 virus is a viral particle containing just the adenovirus cis-elements necessary for replication and virion encapsidation. That is, the vector contains the cis-acting 5' and 3' inverted terminal repeat (ITR) sequences of the adenoviruses (which function as origins of replication) and the native 5' packaging/enhancer domains (that contain sequences necessary for packaging linear Ad genomes and enhancer elements for the E1 promoter). See, for example, the techniques described for preparation of a "minimal" human Ad vector in International Patent Application WO96/13597 and incorporated herein by reference.

V.E.6. Other Defective Adenoviruses

Recombinant, replication-deficient adenoviruses can also contain more than the minimal chimpanzee adenovirus sequences. These other Ad vectors can be characterized by deletions of various portions of gene regions of the virus, and infectious virus particles formed by the optional use of helper viruses and/or packaging cell lines.

As one example, suitable vectors may be formed by deleting all or a sufficient portion of the C68 adenoviral immediate early gene E1a and delayed early gene E1b, so as to eliminate their normal biological functions. Replication-defective E1-deleted viruses are capable of replicating and producing infectious virus when grown on a chimpanzee adenovirus-transformed, complementation cell line containing functional adenovirus E1a and E1b genes which provide the corresponding gene products in trans. Based on the homologies to known adenovirus sequences, it is anticipated that, as is true for the human recombinant E1-deleted adenoviruses of the art, the resulting recombinant chimpanzee adenovirus is capable of infecting many cell types and can express antigen(s), but cannot replicate in most cells that do not carry the chimpanzee E1 region DNA unless the cell is infected at a very high multiplicity of infection.

As another example, all or a portion of the C68 adenovirus delayed early gene E3 can be eliminated from the chimpanzee adenovirus sequence which forms a part of the recombinant virus.

Chimpanzee adenovirus C68 vectors can also be constructed having a deletion of the E4 gene. Still another vector can contain a deletion in the delayed early gene E2a.

Deletions can also be made in any of the late genes L1 through L5 of the chimpanzee C68 adenovirus genome. Similarly, deletions in the intermediate genes IX and IVa2 can be useful for some purposes. Other deletions may be made in the other structural or non-structural adenovirus genes.

The above discussed deletions can be used individually, i.e., an adenovirus sequence can contain deletions of E1 only. Alternatively, deletions of entire genes or portions thereof effective to destroy or reduce their biological activity can be used in any combination. For example, in one exemplary vector, the adenovirus C68 sequence can have deletions of the E1 genes and the E4 gene, or of the E1, E2a and E3 genes, or of the E1 and E3 genes, or of E1, E2a and E4 genes, with or without deletion of E3, and so on. As discussed above, such deletions can be used in combination with other mutations, such as temperature-sensitive mutations, to achieve a desired result.

The cassette comprising antigen(s) be inserted optionally into any deleted region of the chimpanzee C68 Ad virus. Alternatively, the cassette can be inserted into an existing gene region to disrupt the function of that region, if desired.

V.E.7. Helper Viruses

Depending upon the chimpanzee adenovirus gene content of the viral vectors employed to carry the cassette, a helper adenovirus or non-replicating virus fragment can be used to provide sufficient chimpanzee adenovirus gene sequences to produce an infective recombinant viral particle containing the cassette.

Useful helper viruses contain selected adenovirus gene sequences not present in the adenovirus vector construct and/or not expressed by the packaging cell line in which the vector is transfected. A helper virus can be replication-defective and contain a variety of adenovirus genes in addition to the sequences described above. The helper virus can be used in combination with the E1-expressing cell lines described herein.

For C68, the "helper" virus can be a fragment formed by clipping the C terminal end of the C68 genome with SspI, which removes about 1300 bp from the left end of the virus. This clipped virus is then co-transfected into an E1-expressing cell line with the plasmid DNA, thereby forming the recombinant virus by homologous recombination with the C68 sequences in the plasmid.

Helper viruses can also be formed into poly-cation conjugates as described in Wu et al, J. Biol. Chem., 264:16985-16987 (1989); K. J. Fisher and J. M. Wilson, Biochem. J., 299:49 (Apr. 1, 1994). Helper virus can optionally contain a reporter gene. A number of such reporter genes are known to the art. The presence of a reporter gene on the helper virus which is different from the cassette on the adenovirus vector allows both the Ad vector and the helper virus to be independently monitored. This second reporter is used to enable separation between the resulting recombinant virus and the helper virus upon purification.

V.E.8. Assembly of Viral Particle and Infection of a Cell Line

Assembly of the selected DNA sequences of the adenovirus, the cassette, and other vector elements into various intermediate plasmids and shuttle vectors, and the use of the plasmids and vectors to produce a recombinant viral particle can all be achieved using conventional techniques. Such techniques include conventional cloning techniques of cDNA, in vitro recombination techniques (e.g., Gibson assembly), use of overlapping oligonucleotide sequences of the adenovirus genomes, polymerase chain reaction, and any suitable method which provides the desired nucleic acid sequence. Standard transfection and co-transfection techniques are employed, e.g., CaPO4 precipitation techniques or liposome-mediated transfection methods such as lipofectamine. Other conventional methods employed include homologous recombination of the viral genomes, plaquing of viruses in agar overlay, methods of measuring signal generation, and the like.

For example, following the construction and assembly of the desired cassette-containing viral vector, the vector can be transfected in vitro in the presence of a helper virus into the packaging cell line. Homologous recombination occurs between the helper and the vector sequences, which permits the adenovirus-antigen sequences in the vector to be replicated and packaged into virion capsids, resulting in the recombinant viral vector particles.

The resulting recombinant chimpanzee C68 adenoviruses are useful in transferring a cassette to a selected cell. In in vivo experiments with the recombinant virus grown in the packaging cell lines, the E1-deleted recombinant chimpanzee adenovirus demonstrates utility in transferring a cassette to a non-chimpanzee, preferably a human, cell.

V.E.9. Use of the Recombinant Virus Vectors

The resulting recombinant chimpanzee C68 adenovirus containing the cassette (produced by cooperation of the adenovirus vector and helper virus or adenoviral vector and packaging cell line, as described above) thus provides an efficient gene transfer vehicle which can deliver antigen(s) to a subject in vivo or ex vivo.

The above-described recombinant vectors are administered to humans according to published methods for gene therapy. A chimpanzee viral vector bearing a cassette can be administered to a patient, preferably suspended in a biologically compatible solution or pharmaceutically acceptable delivery vehicle. A suitable vehicle includes sterile saline. Other aqueous and non-aqueous isotonic sterile injection solutions and aqueous and non-aqueous sterile suspensions known to be pharmaceutically acceptable carriers and well known to those of skill in the art may be employed for this purpose.

The chimpanzee adenoviral vectors are administered in sufficient amounts to transduce the human cells and to provide sufficient levels of antigen transfer and expression to provide a therapeutic benefit without undue adverse or with medically acceptable physiological effects, which can be determined by those skilled in the medical arts. Conventional and pharmaceutically acceptable routes of administration include, but are not limited to, direct delivery to the liver, intranasal, intravenous, intramuscular, subcutaneous, intradermal, oral and other parental routes of administration. Routes of administration may be combined, if desired.

Dosages of the viral vector will depend primarily on factors such as the condition being treated, the age, weight and health of the patient, and may thus vary among patients. The dosage will be adjusted to balance the therapeutic benefit against any side effects and such dosages may vary depending upon the therapeutic application for which the recombinant vector is employed. The levels of expression of antigen(s) can be monitored to determine the frequency of dosage administration.

Recombinant, replication defective adenoviruses can be administered in a "pharmaceutically effective amount", that is, an amount of recombinant adenovirus that is effective in a route of administration to transfect the desired cells and provide sufficient levels of expression of the selected gene to provide a vaccinal benefit, i.e., some measurable level of protective immunity. C68 vectors comprising a cassette can be co-administered with adjuvant. Adjuvant can be separate from the vector (e.g., alum) or encoded within the vector, in particular if the adjuvant is a protein. Adjuvants are well known in the art.

Conventional and pharmaceutically acceptable routes of administration include, but are not limited to, intranasal, intramuscular, intratracheal, subcutaneous, intradermal, rectal, oral and other parental routes of administration. Routes of administration may be combined, if desired, or adjusted depending upon the immunogen or the disease. For example, in prophylaxis of rabies, the subcutaneous, intratracheal and intranasal routes are preferred. The route of administration primarily will depend on the nature of the disease being treated.

The levels of immunity to antigen(s) can be monitored to determine the need, if any, for boosters. Following an assessment of antibody titers in the serum, for example, optional booster immunizations may be desired

VI. Therapeutic and Manufacturing Methods

Also provided is a method of inducing a tumor specific immune response in a subject, vaccinating against a tumor, treating and/or alleviating a symptom of cancer in a subject by administering to the subject one or more antigens such as a plurality of antigens identified using methods disclosed herein.

Also provided is a method of inducing an infectious disease organism-specific immune response in a subject, vaccinating against an infectious disease organism, treating and/or alleviating a symptom of an infection associated with an infectious disease organism in a subject by administering to the subject one or more antigens such as a plurality of antigens identified using methods disclosed herein.

In some aspects, a subject has been diagnosed with cancer or is at risk of developing cancer. A subject can be a human, dog, cat, horse or any animal in which a tumor specific immune response is desired. A tumor can be any solid tumor such as breast, ovarian, prostate, lung, kidney, gastric, colon, testicular, head and neck, pancreas, brain, melanoma, and other tumors of tissue organs and hematological tumors, such as lymphomas and leukemias, including acute myelogenous leukemia, chronic myelogenous leukemia, chronic lymphocytic leukemia, T cell lymphocytic leukemia, and B cell lymphomas.

In some aspects, a subject has been diagnosed with an infection or is at risk of an infection (e.g., age, geographical/travel, and/or work-related increased risk of or predisposition to an infection, or at risk to a seasonal and/or novel disease infection).

An antigen can be administered in an amount sufficient to induce a CTL response. An antigen can be administered in an amount sufficient to induce a T cell response. An antigen can be administered in an amount sufficient to induce a B cell response.

An antigen can be administered alone or in combination with other therapeutic agents. The therapeutic agent is for example, a chemotherapeutic agent, radiation, or immunotherapy. Any suitable therapeutic treatment for a particular cancer can be administered. Therapeutic agents can include those that target an infectious disease organism, such as an anti-viral or antibiotic agent.

In addition, a subject can be further administered an anti-immunosuppressive/immunostimulatory agent such as a checkpoint inhibitor. For example, the subject can be further administered an anti-CTLA antibody or anti-PD-1 or anti-PD-L1. Blockade of CTLA-4 or PD-L1 by antibodies can enhance the immune response to cancerous cells in the patient. In particular, CTLA-4 blockade has been shown effective when following a vaccination protocol.

The optimum amount of each antigen to be included in a vaccine composition and the optimum dosing regimen can be determined. For example, an antigen or its variant can be prepared for intravenous (i.v.) injection, sub-cutaneous (s.c.) injection, intradermal (i.d.) injection, intraperitoneal (i.p.) injection, intramuscular (i.m.) injection. Methods of injection include s.c., i.d., i.p., i.m., and i.v. Methods of DNA or RNA injection include i.d., i.m., s.c., i.p. and i.v. Other methods of administration of the vaccine composition are known to those skilled in the art.

A vaccine can be compiled so that the selection, number and/or amount of antigens present in the composition is/are tissue, cancer, infectious disease, and/or patient-specific. For instance, the exact selection of peptides can be guided by expression patterns of the parent proteins in a given tissue or guided by mutation or disease status of a patient. The selection can be dependent on the specific type of cancer, the specific infectious disease, the status of the disease, the goal of the vaccination (e.g., preventative or targeting an ongoing disease), earlier treatment regimens, the immune status of the patient, and, of course, the HLA-haplotype of the patient. Furthermore, a vaccine can contain individualized components, according to personal needs of the particular patient. Examples include varying the selection of antigens according to the expression of the antigen in the particular patient or adjustments for secondary treatments following a first round or scheme of treatment.

A patient can be identified for administration of an antigen vaccine through the use of various diagnostic methods, e.g., patient selection methods described further below. Patient selection can involve identifying mutations in, or expression patterns of, one or more genes. Patient selection can involve identifying the infectious disease of an ongoing infection. Patient selection can involve identifying risk of an infection by an infectious disease. In some cases, patient selection involves identifying the haplotype of the patient. The various patient selection methods can be performed in parallel, e.g., a sequencing diagnostic can identify both the mutations and the haplotype of a patient. The various patient selection methods can be performed sequentially, e.g., one diagnostic test identifies the mutations and separate diagnostic test identifies the haplotype of a patient, and where each test can be the same (e.g., both high-throughput sequencing) or different (e.g., one high-throughput sequencing and the other Sanger sequencing) diagnostic methods.

For a composition to be used as a vaccine for cancer or an infectious disease, antigens with similar normal self-peptides that are expressed in high amounts in normal tissues can be avoided or be present in low amounts in a composition described herein. On the other hand, if it is known that the tumor or infected cell of a patient expresses high amounts of a certain antigen, the respective pharmaceutical composition for treatment of this cancer or infection can be present in high amounts and/or more than one antigen specific for this particularly antigen or pathway of this antigen can be included.

Compositions comprising an antigen can be administered to an individual already suffering from cancer or an infection. In therapeutic applications, compositions are administered to a patient in an amount sufficient to elicit an effective CTL response to the tumor antigen or infectious disease organism antigen and to cure or at least partially arrest symptoms and/or complications. An amount adequate to accomplish this is defined as "therapeutically effective dose." Amounts effective for this use will depend on, e.g., the composition, the manner of administration, the stage and severity of the disease being treated, the weight and general state of health of the patient, and the judgment of the prescribing physician. It should be kept in mind that compositions can generally be employed in serious disease states, that is, life-threatening or potentially life threatening situations, especially when the cancer has metastasized. In such cases, in view of the minimization of extraneous substances and the relative nontoxic nature of an antigen, it is possible and can be felt desirable by the treating physician to administer substantial excesses of these compositions.

For therapeutic use, administration can begin at the detection or surgical removal of tumors or begin at the detection or treatment of an infection. This can be followed by boosting doses until at least symptoms are substantially abated and for a period thereafter.

The pharmaceutical compositions (e.g., vaccine compositions) for therapeutic treatment are intended for parenteral, topical, nasal, oral or local administration. A pharmaceutical compositions can be administered parenterally, e.g., intravenously, subcutaneously, intradermally, or intramuscularly. The compositions can be administered at the site of surgical excision to induce a local immune response to the tumor. The compositions can be administered to target specific infected tissues and/or cells (e.g., antigen presenting cells) of a subject. Disclosed herein are compositions for parenteral administration which comprise a solution of the antigen and vaccine compositions are dissolved or suspended in an acceptable carrier, e.g., an aqueous carrier. A variety of aqueous carriers can be used, e.g., water, buffered water, 0.9% saline, 0.3% glycine, hyaluronic acid and the like. These compositions can be sterilized by conventional, well known sterilization techniques, or can be sterile filtered. The resulting aqueous solutions can be packaged for use as is, or lyophilized, the lyophilized preparation being combined with a sterile solution prior to administration. The compositions may contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc.

Antigens can also be administered via liposomes, which target them to a particular cells tissue, such as lymphoid tissue. Liposomes are also useful in increasing half-life. Liposomes include emulsions, foams, micelles, insoluble monolayers, liquid crystals, phospholipid dispersions, lamellar layers and the like. In these preparations the antigen to be delivered is incorporated as part of a liposome, alone or in conjunction with a molecule which binds to, e.g., a receptor prevalent among lymphoid cells, such as monoclonal antibodies which bind to the CD45 antigen, or with other therapeutic or immunogenic compositions. Thus, liposomes filled with a desired antigen can be directed to the site of lymphoid cells, where the liposomes then deliver the selected therapeutic/immunogenic compositions. Liposomes can be formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka et al., Ann. Rev. Biophys. Bioeng. 9; 467 (1980), U.S. Pat. Nos. 4,235,871, 4,501,728, 4,501,728, 4,837,028, and 5,019,369.

For targeting to the immune cells, a ligand to be incorporated into the liposome can include, e.g., antibodies or fragments thereof specific for cell surface determinants of the desired immune system cells. A liposome suspension can be administered intravenously, locally, topically, etc. in a dose which varies according to, inter alia, the manner of administration, the peptide being delivered, and the stage of the disease being treated.

For therapeutic or immunization purposes, nucleic acids encoding a peptide and optionally one or more of the peptides described herein can also be administered to the patient. A number of methods are conveniently used to deliver the nucleic acids to the patient. For instance, the nucleic acid can be delivered directly, as "naked DNA". This approach is described, for instance, in Wolff et al., Science 247: 1465-1468 (1990) as well as U.S. Pat. Nos. 5,580,859 and 5,589,466. The nucleic acids can also be administered using ballistic delivery as described, for instance, in U.S. Pat. No. 5,204,253. Particles comprised solely of DNA can be administered. Alternatively, DNA can be adhered to particles, such as gold particles. Approaches for delivering nucleic acid sequences can include viral vectors, mRNA vectors, and DNA vectors with or without electroporation.

The nucleic acids can also be delivered complexed to cationic compounds, such as cationic lipids. Lipid-mediated gene delivery methods are described, for instance, in 9618372WOAWO 96/18372; 9324640WOAWO 93/24640; Mannino & Gould-Fogerite, BioTechniques 6(7): 682-691 (1988); U.S. Pat. No. 5,279,833 Rose U.S. Pat. No. 5,279,833; 9106309WOAWO 91/06309; and Felgner et al., Proc. Natl. Acad. Sci. USA 84: 7413-7414 (1987).

Antigens can also be included in viral vector-based vaccine platforms, such as vaccinia, fowlpox, self-replicating alphavirus, marabavirus, adenovirus (See, e.g., Tatsis et al., Adenoviruses, *Molecular Therapy* (2004) 10, 616-629), or lentivirus, including but not limited to second, third or hybrid second/third generation lentivirus and recombinant lentivirus of any generation designed to target specific cell types or receptors (See, e.g., Hu et al., Immunization Delivered by Lentiviral Vectors for Cancer and Infectious Diseases, *Immunol Rev*. (2011) 239(1): 45-61, Sakuma et al., Lentiviral vectors: basic to translational, *Biochem J*. (2012) 443(3):603-18, Cooper et al., Rescue of splicing-mediated intron loss maximizes expression in lentiviral vectors containing the human ubiquitin C promoter, *Nucl. Acids Res.* (2015) 43 (1): 682-690, Zufferey et al., Self-Inactivating Lentivirus Vector for Safe and Efficient In Vivo Gene Delivery, *J. Virol*. (1998) 72 (12): 9873-9880). Dependent on the packaging capacity of the above mentioned viral vector-based vaccine platforms, this approach can deliver one or more nucleic acid sequences that encode one or more antigen peptides. The sequences may be flanked by non-mutated sequences, may be separated by linkers or may be preceded with one or more sequences targeting a subcellular compartment (See, e.g., Gros et al., Prospective identification of neoantigen-specific lymphocytes in the peripheral blood of melanoma patients, *Nat Med*. (2016) 22 (4):433-8, Stronen et al., Targeting of cancer neoantigens with donor-derived T cell receptor repertoires, *Science*. (2016) 352

(6291):1337-41, Lu et al., Efficient identification of mutated cancer antigens recognized by T cells associated with durable tumor regressions, *Clin Cancer Res.* (2014) 20(13): 3401-10). Upon introduction into a host, infected cells express the antigens, and thereby elicit a host immune (e.g., CTL) response against the peptide(s). Vaccinia vectors and methods useful in immunization protocols are described in, e.g., U.S. Pat. No. 4,722,848. Another vector is BCG (Bacille Calmette Guerin). BCG vectors are described in Stover et al. (Nature 351:456-460 (1991)). A wide variety of other vaccine vectors useful for therapeutic administration or immunization of antigens, e.g., *Salmonella typhi* vectors, and the like will be apparent to those skilled in the art from the description herein.

A means of administering nucleic acids uses minigene constructs encoding one or multiple epitopes. To create a DNA sequence encoding the selected CTL epitopes (minigene) for expression in human cells, the amino acid sequences of the epitopes are reverse translated. A human codon usage table is used to guide the codon choice for each amino acid. These epitope-encoding DNA sequences are directly adjoined, creating a continuous polypeptide sequence. To optimize expression and/or immunogenicity, additional elements can be incorporated into the minigene design. Examples of amino acid sequence that could be reverse translated and included in the minigene sequence include: helper T lymphocyte, epitopes, a leader (signal) sequence, and an endoplasmic reticulum retention signal. In addition, MHC presentation of CTL epitopes can be improved by including synthetic (e.g. poly-alanine) or naturally-occurring flanking sequences adjacent to the CTL epitopes. The minigene sequence is converted to DNA by assembling oligonucleotides that encode the plus and minus strands of the minigene. Overlapping oligonucleotides (30-100 bases long) are synthesized, phosphorylated, purified and annealed under appropriate conditions using well known techniques. The ends of the oligonucleotides are joined using T4 DNA ligase. This synthetic minigene, encoding the CTL epitope polypeptide, can then cloned into a desired expression vector.

Purified plasmid DNA can be prepared for injection using a variety of formulations. The simplest of these is reconstitution of lyophilized DNA in sterile phosphate-buffer saline (PBS). A variety of methods have been described, and new techniques can become available. As noted above, nucleic acids are conveniently formulated with cationic lipids. In addition, glycolipids, fusogenic liposomes, peptides and compounds referred to collectively as protective, interactive, non-condensing (PINC) could also be complexed to purified plasmid DNA to influence variables such as stability, intramuscular dispersion, or trafficking to specific organs or cell types.

Also disclosed is a method of manufacturing a vaccine, comprising performing the steps of a method disclosed herein; and producing a vaccine comprising a plurality of antigens or a subset of the plurality of antigens. Also disclosed is a method of manufacturing adenoviral vector, comprising performing the steps of a method disclosed herein; and producing an adenoviral vector comprising a cassette. For example, disclosed is a method of manufacturing adenoviral vector using a TET promoter system, such as the TETr controlled promoter system described herein. Viral production using the TETr controlled promoter system can include a. providing a viral vector comprising a cassette, the cassette comprising: (i) at least one payload nucleic acid sequence, and (ii) at least one promoter sequence operably linked to the at least one payload nucleic acid sequence, wherein the at least one promoter is a tetracycline (TET) repressor protein (TETr) controlled promoter, b. providing a cell engineered to express the TETr protein; and c. contacting the viral vector with the cell under conditions sufficient for production of the virus.

Antigens disclosed herein can be manufactured using methods known in the art. For example, a method of producing an antigen or a vector (e.g., a vector including at least one sequence encoding one or more antigens) disclosed herein can include culturing a host cell under conditions suitable for expressing the antigen or vector wherein the host cell comprises at least one polynucleotide encoding the antigen or vector, and purifying the antigen or vector. Standard purification methods include chromatographic techniques, electrophoretic, immunological, precipitation, dialysis, filtration, concentration, and chromatofocusing techniques.

Host cells can include a Chinese Hamster Ovary (CHO) cell, NS0 cell, yeast, or a HEK293 cell. Host cells can be transformed with one or more polynucleotides comprising at least one nucleic acid sequence that encodes an antigen or vector disclosed herein, optionally wherein the isolated polynucleotide further comprises a promoter sequence operably linked to the at least one nucleic acid sequence that encodes the antigen or vector. In certain embodiments the isolated polynucleotide can be cDNA.

VII. Antigen Use and Administration

A vaccination protocol can be used to dose a subject with one or more antigens. A priming vaccine and a boosting vaccine can be used to dose the subject. The priming vaccine can be based on C68 (e.g., the sequences shown in SEQ ID NO:1 or 2) or srRNA (e.g., the sequences shown in SEQ ID NO:3 or 4) and the boosting vaccine can be based on C68 (e.g., the sequences shown in SEQ ID NO:1 or 2) or srRNA (e.g., the sequences shown in SEQ ID NO:3 or 4). Each vector typically includes a cassette that includes antigens. Cassettes can include about 20 antigens, separated by spacers such as the natural sequence that normally surrounds each antigen or other non-natural spacer sequences such as AAY. Cassettes can also include MHCII antigens such a tetanus toxoid antigen and PADRE antigen, which can be considered universal class II antigens. Cassettes can also include a targeting sequence such as a ubiquitin targeting sequence. In addition, each vaccine dose can be administered to the subject in conjunction with (e.g., concurrently, before, or after) a checkpoint inhibitor (CPI). CPI's can include those that inhibit CTLA4, PD1, and/or PDL1 such as antibodies or antigen-binding portions thereof. Such antibodies can include tremelimumab or durvalumab.

A priming vaccine can be injected (e.g., intramuscularly) in a subject. Bilateral injections per dose can be used. For example, one or more injections of ChAdV68 (C68) can be used (e.g., total dose $1\times10^{12}$ viral particles); one or more injections of self-replicating RNA (srRNA) at low vaccine dose selected from the range 0.001 to 1 ug RNA, in particular 0.1 or 1 ug can be used; or one or more injections of srRNA at high vaccine dose selected from the range 1 to 100 ug RNA, in particular 10 or 100 ug can be used.

A vaccine boost (boosting vaccine) can be injected (e.g., intramuscularly) after prime vaccination. A boosting vaccine can be administered about every 1, 2, 3, 4, 5, 6, 7, 8, 9, or 10 weeks, e.g., every 4 weeks and/or 8 weeks after the prime. Bilateral injections per dose can be used. For example, one or more injections of ChAdV68 (C68) can be used (e.g., total dose $1\times10^{12}$ viral particles); one or more injections of self-replicating RNA (srRNA) at low vaccine dose selected from the range 0.001 to 1 ug RNA, in particular 0.1 or 1 ug can be used; or one or more injections of srRNA at high vaccine dose selected from the range 1 to 100 ug RNA, in particular 10 or 100 ug can be used.

Anti-CTLA-4 (e.g., tremelimumab) can also be administered to the subject. For example, anti-CTLA4 can be administered subcutaneously near the site of the intramuscular vaccine injection (ChAdV68 prime or srRNA low doses) to ensure drainage into the same lymph node. Tremelimumab is a selective human IgG2 mAb inhibitor of CTLA-4. Target Anti-CTLA-4 (tremelimumab) subcutaneous dose is typically 70-75 mg (in particular 75 mg) with a dose range of, e.g., 1-100 mg or 5-420 mg.

In certain instances an anti-PD-L1 antibody can be used such as durvalumab (MEDI 4736). Durvalumab is a selective, high affinity human IgGI mAb that blocks PD-L1 binding to PD-1 and CD80. Durvalumab is generally administered at 20 mg/kg i.v. every 4 weeks.

Immune monitoring can be performed before, during, and/or after vaccine administration. Such monitoring can inform safety and efficacy, among other parameters.

To perform immune monitoring, PBMCs are commonly used. PBMCs can be isolated before prime vaccination, and after prime vaccination (e.g. 4 weeks and 8 weeks). PBMCs can be harvested just prior to boost vaccinations and after each boost vaccination (e.g. 4 weeks and 8 weeks).

T cell responses can be assessed as part of an immune monitoring protocol. For example, the ability of a vaccine composition described herein to stimulate an immune response can be monitored and/or assessed. As used herein, "stimulate an immune response" refers to any increase in an immune response, such as initiating an immune response (e.g., a priming vaccine stimulating the initiation of an immune response in a naïve subject) or enhancement of an immune response (e.g., a boosting vaccine stimulating the enhancement of an immune response in a subject having a pre-existing immune response to an antigen, such as a pre-existing immune response initiated by a priming vaccine). T cell responses can be measured using one or more methods known in the art such as ELISpot, intracellular cytokine staining, cytokine secretion and cell surface capture, T cell proliferation, MHC multimer staining, or by cytotoxicity assay. T cell responses to epitopes encoded in vaccines can be monitored from PBMCs by measuring induction of cytokines, such as IFN-gamma, using an ELISpot assay. Specific CD4 or CD8 T cell responses to epitopes encoded in vaccines can be monitored from PBMCs by measuring induction of cytokines captured intracellularly or extracellularly, such as IFN-gamma, using flow cytometry. Specific CD4 or CD8 T cell responses to epitopes encoded in the vaccines can be monitored from PBMCs by measuring T cell populations expressing T cell receptors specific for epitope/MHC class I complexes using MHC multimer staining. Specific CD4 or CD8 T cell responses to epitopes encoded in the vaccines can be monitored from PBMCs by measuring the ex vivo expansion of T cell populations following 3H-thymidine, bromodeoxyuridine and carboxyfluoresceine-diacetate-succinimidylester (CFSE) incorporation. The antigen recognition capacity and lytic activity of PBMC-derived T cells that are specific for epitopes encoded in vaccines can be assessed functionally by chromium release assay or alternative colorimetric cytotoxicity assays.

B cell responses can be measured using one or more methods known in the art such as assays used to determine B cell differentiation (e.g., differentiation into plasma cells), B cell or plasma cell proliferation, B cell or plasma cell activation (e.g., upregulation of costimulatory markers such as CD80 or CD86), antibody class switching, and/or antibody production (e.g., an ELISA).

VIII. Antigen Identification

VIII.A. Antigen Candidate Identification

Research methods for NGS analysis of tumor and normal exome and transcriptomes have been described and applied in the antigen identification space.[6,14,15] Certain optimizations for greater sensitivity and specificity for antigen identification in the clinical setting can be considered. These optimizations can be grouped into two areas, those related to laboratory processes and those related to the NGS data analysis. The research methods described can also be applied to identification of antigens in other settings, such as identification of identifying antigens from an infectious disease organism, an infection in a subject, or an infected cell of a subject. Examples of optimizations are known to those skilled in the art, for example the methods described in more detail in U.S. Pat. No. 10,055,540, US Application Pub. No. US20200010849A1, and international patent application publications WO/2018/195357 and WO/2018/208856, each herein incorporated by reference, in their entirety, for all purposes.

VIII.B. Isolation and Detection of HLA Peptides

Isolation of HLA-peptide molecules was performed using classic immunoprecipitation (IP) methods after lysis and solubilization of the tissue sample (55-58). A clarified lysate was used for HLA specific IP.

Immunoprecipitation was performed using antibodies coupled to beads where the antibody is specific for HLA molecules. For a pan-Class I HLA immunoprecipitation, a pan-Class I CR antibody is used, for Class II HLA-DR, an HLA-DR antibody is used. Antibody is covalently attached to NHS-sepharose beads during overnight incubation. After covalent attachment, the beads were washed and aliquoted for IP. (59, 60) Immunoprecipitations can also be performed with antibodies that are not covalently attached to beads. Typically this is done using sepharose or magnetic beads coated with Protein A and/or Protein G to hold the antibody to the column. Some antibodies that can be used to selectively enrich MHC/peptide complex are listed below.

| Antibody Name | Specificity |
|---|---|
| W6/32 | Class I HLA-A, B, C |
| L243 | Class II-HLA-DR |
| Tu36 | Class II-HLA-DR |
| LN3 | Class II-HLA-DR |
| Tu39 | Class II-HLA-DR, DP, DQ |

The clarified tissue lysate is added to the antibody beads for the immunoprecipitation. After immunoprecipitation, the beads are removed from the lysate and the lysate stored for additional experiments, including additional IPs. The IP beads are washed to remove non-specific binding and the HLA/peptide complex is eluted from the beads using standard techniques. The protein components are removed from the peptides using a molecular weight spin column or C18 fractionation. The resultant peptides are taken to dryness by SpeedVac evaporation and in some instances are stored at −20 C prior to MS analysis.

Dried peptides are reconstituted in an HPLC buffer suitable for reverse phase chromatography and loaded onto a C-18 microcapillary HPLC column for gradient elution in a Fusion Lumos mass spectrometer (Thermo). MS1 spectra of peptide mass/charge (m/z) were collected in the Orbitrap detector at high resolution followed by MS2 low resolution scans collected in the ion trap detector after HCD fragmentation of the selected ion. Additionally, MS2 spectra can be obtained using either CID or ETD fragmentation methods or any combination of the three techniques to attain greater amino acid coverage of the peptide. MS2 spectra can also be measured with high resolution mass accuracy in the Orbitrap detector.

MS2 spectra from each analysis are searched against a protein database using Comet (61, 62) and the peptide identification are scored using Percolator (63-65). Additional sequencing is performed using PEAKS studio (Bioinformatics Solutions Inc.) and other search engines or sequencing methods can be used including spectral matching and de novo sequencing (97).

VIII.B.1. MS Limit of Detection Studies in Support of Comprehensive HLA Peptide Sequencing.

Figure 24A:
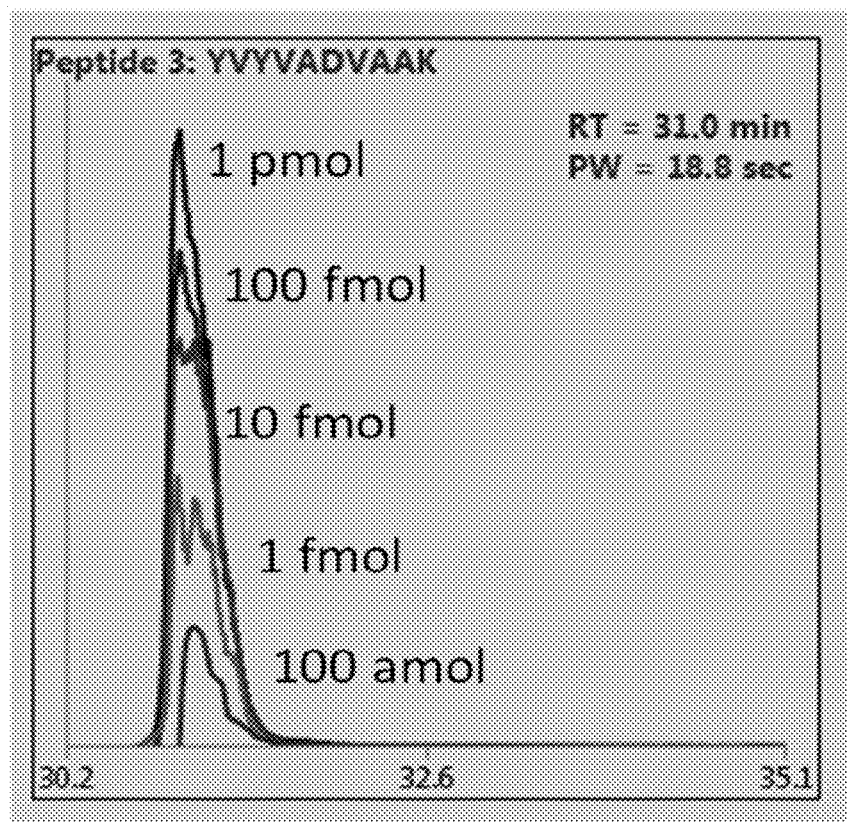
FIG. 24A shows an example peptide spectrum generated from Promega's dynamic range standard.
Figure 24B:
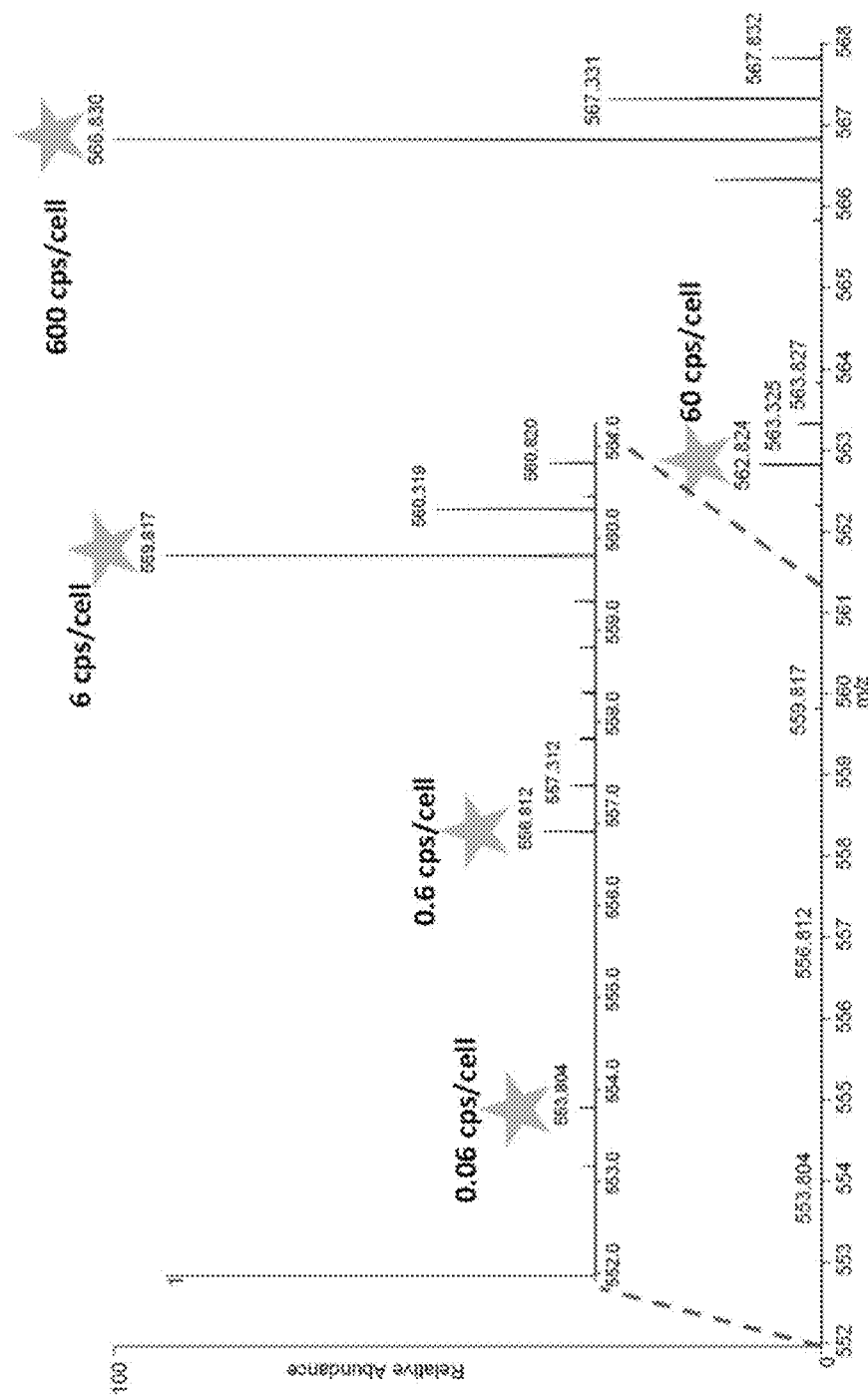
FIG. 24B shows an example peptide spectrum generated from Promega's dynamic range standard.

Using the peptide YVYVADVAAK (SEQ ID NO: 77) it was determined what the limits of detection are using different amounts of peptide loaded onto the LC column. The amounts of peptide tested were 1 pmol, 100 fmol, 10 fmol, 1 fmol, and 100 amol. (Table 1) The results are shown in FIGS. 24A and 24B. These results indicate that the lowest limit of detection (LoD) is in the attomol range ($10^{-18}$), that the dynamic range spans five orders of magnitude, and that the signal to noise appears sufficient for sequencing at low femtomol ranges ($10^{-15}$).

TABLE 1

| Peptide m/z | Loaded on Column | Copies/Cell in 1e9cells |
|---|---|---|
| 566.830 | 1 pmol | 600 |
| 562.823 | 100 fmol | 60 |
| 559.816 | 10 fmol | 6 |
| 556.810 | 1 fmol | 0.6 |
| 553.802 | 100 amol | 0.06 |

IX. Presentation Model

Presentation models can be used to identify likelihoods of peptide presentation in patients. Various presentation models are known to those skilled in the art, for example the presentation models described in more detail in U.S. Pat. No. 10,055,540, US Application Pub. No. US20200010849A1 and US20110293637, and international patent application publications WO/2018/195357, WO/2018/208856, and WO2016187508, each herein incorporated by reference, in their entirety, for all purposes.

X. Training Module

Training modules can be used to construct one or more presentation models based on training data sets that generate likelihoods of whether peptide sequences will be presented by MHC alleles associated with the peptide sequences. Various training modules are known to those skilled in the art, for example the presentation models described in more detail in U.S. Pat. No. 10,055,540, US Application Pub. No. US20200010849A1, and international patent application publications WO/2018/195357, and WO/2018/208856, each herein incorporated by reference, in their entirety, for all purposes. A training module can construct a presentation model to predict presentation likelihoods of peptides on a per-allele basis. A training module can also construct a presentation model to predict presentation likelihoods of peptides in a multiple-allele setting where two or more MHC alleles are present.

XI. Prediction Module

A prediction module can be used to receive sequence data and select candidate antigens in the sequence data using a presentation model. Specifically, the sequence data may be DNA sequences, RNA sequences, and/or protein sequences extracted from tumor tissue cells of patients, infected cells patients, or infectious disease organisms themselves. A prediction module may identify candidate neoantigens that are mutated peptide sequences by comparing sequence data extracted from normal tissue cells of a patient with the sequence data extracted from tumor tissue cells of the patient to identify portions containing one or more mutations. A prediction module may identify candidate antigens that are pathogen-derived peptides, virally-derived peptides, bacterially-derived peptides, fungally-derived peptides, and parasitically-derived peptides, such as by comparing sequence data extracted from normal tissue cells of a patient with the sequence data extracted from infected cells of the patient to identify portions containing one or more infectious disease organism associated antigens. A prediction module may identify candidate antigens that have altered expression in a tumor cell or cancerous tissue in comparison to a normal cell or tissue by comparing sequence data extracted from normal tissue cells of a patient with the sequence data extracted from tumor tissue cells of the patient to identify improperly expressed candidate antigens. A prediction module may identify candidate antigens that are expressed in an infected cell or infected tissue in comparison to a normal cell or tissue by comparing sequence data extracted from normal tissue cells of a patient with the sequence data extracted from infected tissue cells of the patient to identify expressed candidate antigens (e.g., identifying expressed polynucleotides and/or polypeptides specific to an infectious disease).

A presentation module can apply one or more presentation model to processed peptide sequences to estimate presentation likelihoods of the peptide sequences. Specifically, the prediction module may select one or more candidate antigen peptide sequences that are likely to be presented on tumor HLA molecules or infected cell HLA molecules by applying presentation models to the candidate antigens. In one implementation, the presentation module selects candidate antigen sequences that have estimated presentation likelihoods above a predetermined threshold. In another implementation, the presentation model selects the N candidate antigen sequences that have the highest estimated presentation likelihoods (where N is generally the maximum number of epitopes that can be delivered in a vaccine). A vaccine including the selected candidate antigens for a given patient can be injected into the patient to induce immune responses.

XI.B. Cassette Design Module

XI.B.1 Overview

A cassette design module can be used to generate a vaccine cassette sequence based on selected candidate peptides for injection into a patient. Various cassette design modules are known to those skilled in the art, for example the cassette design modules described in more detail in U.S. Pat. No. 10,055,540, US Application Pub. No. US20200010849A1, and international patent application publications WO/2018/195357 and WO/2018/208856, each herein incorporated by reference, in their entirety, for all purposes.

A set of therapeutic epitopes may be generated based on the selected peptides determined by a prediction module associated with presentation likelihoods above a predetermined threshold, where the presentation likelihoods are determined by the presentation models. However it is appreciated that in other embodiments, the set of therapeutic epitopes may be generated based on any one or more of a number of methods (alone or in combination), for example, based on binding affinity or predicted binding affinity to HLA class I or class II alleles of the patient, binding stability or predicted binding stability to HLA class I or class II alleles of the patient, random sampling, and the like.

Therapeutic epitopes may correspond to selected peptides themselves. Therapeutic epitopes may also include C- and/or N-terminal flanking sequences in addition to the selected peptides. N- and C-terminal flanking sequences can be the native N- and C-terminal flanking sequences of the therapeutic vaccine epitope in the context of its source protein. Therapeutic epitopes can represent a fixed-length epitope Therapeutic epitopes can represent a variable-length epitope, in which the length of the epitope can be varied depending on, for example, the length of the C- or N-flanking sequence. For example, the C-terminal flanking sequence and the N-terminal flanking sequence can each have varying lengths of 2-5 residues, resulting in 16 possible choices for the epitope.

A cassette design module can also generate cassette sequences by taking into account presentation of junction epitopes that span the junction between a pair of therapeutic epitopes in the cassette. Junction epitopes are novel non-self but irrelevant epitope sequences that arise in the cassette due to the process of concatenating therapeutic epitopes and linker sequences in the cassette. The novel sequences of junction epitopes are different from the therapeutic epitopes of the cassette themselves.

A cassette design module can generate a cassette sequence that reduces the likelihood that junction epitopes are presented in the patient. Specifically, when the cassette is injected into the patient, junction epitopes have the potential to be presented by HLA class I or HLA class II alleles of the patient, and stimulate a CD8 or CD4 T-cell response, respectively. Such reactions are often times undesirable because T-cells reactive to the junction epitopes have no therapeutic benefit, and may diminish the immune response to the selected therapeutic epitopes in the cassette by antigenic competition.[76]

A cassette design module can iterate through one or more candidate cassettes, and determine a cassette sequence for which a presentation score of junction epitopes associated with that cassette sequence is below a numerical threshold. The junction epitope presentation score is a quantity associated with presentation likelihoods of the junction epitopes in the cassette, and a higher value of the junction epitope presentation score indicates a higher likelihood that junction epitopes of the cassette will be presented by HLA class I or HLA class II or both.

In one embodiment, a cassette design module may determine a cassette sequence associated with the lowest junction epitope presentation score among the candidate cassette sequences.

A cassette design module may iterate through one or more candidate cassette sequences, determine the junction epitope presentation score for the candidate cassettes, and identify an optimal cassette sequence associated with a junction epitope presentation score below the threshold.

A cassette design module may further check the one or more candidate cassette sequences to identify if any of the junction epitopes in the candidate cassette sequences are self-epitopes for a given patient for whom the vaccine is being designed. To accomplish this, the cassette design module checks the junction epitopes against a known database such as BLAST. In one embodiment, the cassette design module may be configured to design cassettes that avoid junction self-epitopes.

A cassette design module can perform a brute force approach and iterate through all or most possible candidate cassette sequences to select the sequence with the smallest junction epitope presentation score. However, the number of such candidate cassettes can be prohibitively large as the capacity of the vaccine increases. For example, for a vaccine capacity of 20 epitopes, the cassette design module has to iterate through ~$10^{18}$ possible candidate cassettes to determine the cassette with the lowest junction epitope presentation score. This determination may be computationally burdensome (in terms of computational processing resources required), and sometimes intractable, for the cassette design module to complete within a reasonable amount of time to generate the vaccine for the patient. Moreover, accounting for the possible junction epitopes for each candidate cassette can be even more burdensome. Thus, a cassette design module may select a cassette sequence based on ways of iterating through a number of candidate cassette sequences that are significantly smaller than the number of candidate cassette sequences for the brute force approach.

A cassette design module can generate a subset of randomly or at least pseudo-randomly generated candidate cassettes, and selects the candidate cassette associated with a junction epitope presentation score below a predetermined threshold as the cassette sequence. Additionally, the cassette design module may select the candidate cassette from the subset with the lowest junction epitope presentation score as the cassette sequence. For example, the cassette design module may generate a subset of ~1 million candidate cassettes for a set of 20 selected epitopes, and select the candidate cassette with the smallest junction epitope presentation score. Although generating a subset of random cassette sequences and selecting a cassette sequence with a low junction epitope presentation score out of the subset may be sub-optimal relative to the brute force approach, it requires significantly less computational resources thereby making its implementation technically feasible. Further, performing the brute force method as opposed to this more efficient technique may only result in a minor or even negligible improvement injunction epitope presentation score, thus making it not worthwhile from a resource allocation perspective. A cassette design module can determine an improved cassette configuration by formulating the epitope sequence for the cassette as an asymmetric traveling salesman problem (TSP). Given a list of nodes and distances between each pair of nodes, the TSP determines a sequence of nodes associated with the shortest total distance to visit each node exactly once and return to the original node. For example, given cities A, B, and C with known distances between each other, the solution of the TSP generates a closed sequence of cities, for which the total distance traveled to visit each city exactly once is the smallest among possible routes. The asymmetric version of the TSP determines the optimal sequence of nodes when the distance between a pair of nodes are asymmetric. For example, the "distance" for traveling from node A to node B may be different from the "distance" for traveling from node B to node A. By solving for an improved optimal cassette using an asymmetric TSP, the cassette design module can find a cassette sequence that results in a reduced presentation score across the junctions between epitopes of the cassette. The solution of the asymmetric TSP indicates a sequence of therapeutic epitopes that correspond to the order in which the epitopes should be concatenated in a cassette to minimize the junction epitope presentation score across the junctions of the cassette. A cassette sequence determined through this approach can result in a sequence with significantly less presentation of junction epitopes while potentially requiring significantly less computational resources than the random sampling approach, especially when the number of generated candidate cassette sequences is large. Illustrative examples of different computational approaches and comparisons for optimizing cassette design are described in more detail in U.S. Pat. No. 10,055,540, US Application Pub. No. US20200010849A1, and international patent application publications WO/2018/195357 and WO/2018/208856, each herein incorporated by reference, in their entirety, for all purposes.

XI.B.2 Shared Antigen Vaccine Sequence Selection

Shared antigen sequences for inclusion in a shared antigen vaccine and appropriate patients for treatment with such vaccine can be chosen by one of skill in the art using the detailed disclosure provided herein. In certain instances a particular mutation and HLA allele combination can be preferred (e.g., based on sequencing data available from a given subject indicating that each are present in the subject) and subsequently used in combination together to identify a shared neoantigen sequence.

XIII. Example Computer

A computer can be used for any of the computational methods described herein. One skilled in the art will recognize a computer can have different architectures. Examples of computers are known to those skilled in the art, for example the computers described in more detail in U.S. Pat. No. 10,055,540, US Application Pub. No. US20200010849A1, and international patent application publications WO/2018/195357 and WO/2018/208856, each herein incorporated by reference, in their entirety, for all purposes.

XIV. Antigen Delivery Vector Example

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W. H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences*, 18th Edition (Easton, Pennsylvania: Mack Publishing Company, 1990); Carey and Sundberg *Advanced Organic Chemistry* $3^{rd}$ Ed. (Plenum Press) Vols A and B(1992).

XIV.A. Neoantigen Cassette Design

Through vaccination, multiple class I MHC restricted tumor-specific neoantigens (TSNAs) that stimulate the corresponding cellular immune response(s) can be delivered. In one example, a vaccine cassette was engineered to encode multiple epitopes as a single gene product where the epitopes were either embedded within their natural, surrounding peptide sequence or spaced by non-natural linker sequences. Several design parameters were identified that could potentially impact antigen processing and presentation and therefore the magnitude and breadth of the TSNA specific CD8 T cell responses. In the present example, several model cassettes were designed and constructed to evaluate: (1) whether robust T cell responses could be generated to multiple epitopes incorporated in a single expression cassette; (2) what makes an optimal linker placed between the TSNAs within the expression cassette-that leads to optimal processing and presentation of all epitopes; (3) if the relative position of the epitopes within the cassette impact T cell responses; (4) whether the number of epitopes within a cassette influences the magnitude or quality of the T cell responses to individual epitopes; (5) if the addition of cellular targeting sequences improves T cell responses.

Two readouts were developed to evaluate antigen presentation and T cell responses specific for marker epitopes within the model cassettes: (1) an in vitro cell-based screen which allowed assessment of antigen presentation as gauged by the activation of specially engineered reporter T cells (Aarnoudse et al., 2002; Nagai et al., 2012); and (2) an in vivo assay that used HLA-A2 transgenic mice (Vitiello et al., 1991) to assess post-vaccination immunogenicity of cassette-derived epitopes of human origin by their corresponding epitope-specific T cell responses (Cornet et al., 2006; Depla et al., 2008; Ishioka et al., 1999).

XIV.B. Antigen Cassette Design Evaluation

XIV.B.1. Methods and Materials

TCR and Cassette Design and Cloning

The selected TCRs recognize peptides NLVPMVATV (SEQ ID NO: 78) (PDB #5D2N), CLGGLLTMV (SEQ ID NO: 79) (PDB #3REV), GILGFVFTL (SEQ ID NO: 80) (PDB #1OGA) LLFGYPVYV (SEQ ID NO: 81) (PDB #1A07) when presented by A*0201. Transfer vectors were constructed that contain 2A peptide-linked TCR subunits (beta followed by alpha), the EMCV IRES, and 2A-linked CD8 subunits (beta followed by alpha and by the puromycin resistance gene). Open reading frame sequences were codon-optimized and synthesized by GeneArt.

Cell Line Generation for In Vitro Epitope Processing and Presentation Studies

Peptides were purchased from ProImmune or Genscript diluted to 10 mg/mL with 10 mM tris(2-carboxyethyl) phosphine (TCEP) in water/DMSO (2:8, v/v). Cell culture medium and supplements, unless otherwise noted, were from Gibco. Heat inactivated fetal bovine serum (FBShi) was from Seradigm. QUANTI-Luc Substrate, Zeocin, and Puromycin were from InvivoGen. Jurkat-Lucia NFAT Cells (InvivoGen) were maintained in RPMI 1640 supplemented with 10% FBShi, Sodium Pyruvate, and 100 μg/mL Zeocin. Once transduced, these cells additionally received 0.3 μg/mL Puromycin. T2 cells (ATCC CRL-1992) were cultured in Iscove's Medium (IMDM) plus 20% FBShi. U-87 MG (ATCC HTB-14) cells were maintained in MEM Eagles Medium supplemented with 10% FBShi.

Jurkat-Lucia NFAT cells contain an NFAT-inducible Lucia reporter construct. The Lucia gene, when activated by the engagement of the T cell receptor (TCR), causes secretion of a coelenterazine-utilizing luciferase into the culture medium. This luciferase can be measured using the QUANTI-Luc luciferase detection reagent. Jurkat-Lucia cells were transduced with lentivirus to express antigen-specific TCRs. The HIV-derived lentivirus transfer vector was obtained from GeneCopoeia, and lentivirus support plasmids expressing VSV-G (pCMV-VsvG), Rev (pRSV-Rev) and Gag-pol (pCgpV) were obtained from Cell Design Labs.

Lentivirus was prepared by transfection of 50-80% confluent T75 flasks of HEK293 cells with Lipofectamine 2000 (Thermo Fisher), using 40 µl of lipofectamine and 20 µg of the DNA mixture (4:2:1:1 by weight of the transfer plasmid: pCgpV:pRSV-Rev:pCMV-VsvG). 8-10 mL of the virus-containing media were concentrated using the Lenti-X system (Clontech), and the virus resuspended in 100-200 µl of fresh medium. This volume was used to overlay an equal volume of Jurkat-Lucia cells (5×10E4-1×10E6 cells were used in different experiments). Following culture in 0.3 µg/ml puromycin-containing medium, cells were sorted to obtain clonality. These Jurkat-Lucia TCR clones were tested for activity and selectivity using peptide loaded T2 cells.

In Vitro Epitope Processing and Presentation Assay

T2 cells are routinely used to examine antigen recognition by TCRs. T2 cells lack a peptide transporter for antigen processing (TAP deficient) and cannot load endogenous peptides in the endoplasmic reticulum for presentation on the MHC. However, the T2 cells can easily be loaded with exogenous peptides. The five marker peptides (NLVPMVATV (SEQ ID NO: 78), CLGGLLTMV (SEQ ID NO: 79), GLCTLVAML (SEQ ID NO: 82), LLFGYPVYV (SEQ ID NO: 81), GILGFVFTL (SEQ ID NO: 80)) and two irrelevant peptides (WLSLLVPFV (SEQ ID NO: 83), FLLTRICT (SEQ ID NO: 84)) were loaded onto T2 cells. Briefly, T2 cells were counted and diluted to 1×106 cells/mL with IMDM plus 1% FBShi. Peptides were added to result in 10 µg peptide/1×106 cells. Cells were then incubated at 37° C. for 90 minutes. Cells were washed twice with IMDM plus 20% FBShi, diluted to 5×10E5 cells/mL and 100 µL plated into a 96-well Costar tissue culture plate. Jurkat-Lucia TCR clones were counted and diluted to 5×10E5 cells/mL in RPMI 1640 plus 10% FBShi and 100 µL added to the T2 cells. Plates were incubated overnight at 37° C., 5% CO2. Plates were then centrifuged at 400 g for 3 minutes and 20 µL supernatant removed to a white flat bottom Greiner plate. QUANTI-Luc substrate was prepared according to instructions and 50 µL/well added. Luciferase expression was read on a Molecular Devices SpectraMax iE3x.

To test marker epitope presentation by the adenoviral cassettes, U-87 MG cells were used as surrogate antigen presenting cells (APCs) and were transduced with the adenoviral vectors. U-87 MG cells were harvested and plated in culture media as 5×10E5 cells/100 µl in a 96-well Costar tissue culture plate. Plates were incubated for approximately 2 hours at 37° C. Adenoviral cassettes were diluted with MEM plus 10% FBShi to an MOI of 100, 50, 10, 5, 1 and 0 and added to the U-87 MG cells as 5 µl/well. Plates were again incubated for approximately 2 hours at 37° C. Jurkat-Lucia TCR clones were counted and diluted to 5×10E5 cells/mL in RPMI plus 10% FBShi and added to the U-87 MG cells as 100 µL/well. Plates were then incubated for approximately 24 hours at 37° C., 5% CO2. Plates were centrifuged at 400 g for 3 minutes and 20 µL supernatant removed to a white flat bottom Greiner plate. QUANTI-Luc substrate was prepared according to instructions and 50 µL/well added. Luciferase expression was read on a Molecular Devices SpectraMax iE3x.

Mouse Strains for Immunogenicity Studies

Transgenic HLA-A2.1 (HLA-A2 Tg) mice were obtained from Taconic Labs, Inc. These mice carry a transgene consisting of a chimeric class I molecule comprised of the human HLA-A2.1 leader, α1, and α2 domains and the murine H2-Kb α3, transmembrane, and cytoplasmic domains (Vitiello et al., 1991). Mice used for these studies were the first generation offspring (F1) of wild type BALB/cAnNTac females and homozygous HLA-A2.1 Tg males on the C57Bl/6 background.

Adenovirus Vector (Ad5v) Immunizations

HLA-A2 Tg mice were immunized with $1 \times 10^{10}$ to $1 \times 10^6$ viral particles of adenoviral vectors via bilateral intramuscular injection into the tibialis anterior. Immune responses were measured at 12 days post-immunization.

Lymphocyte Isolation

Lymphocytes were isolated from freshly harvested spleens and lymph nodes of immunized mice. Tissues were dissociated in RPMI containing 10% fetal bovine serum with penicillin and streptomycin (complete RPMI) using the GentleMACS tissue dissociator according to the manufacturer's instructions.

Ex Vivo Enzyme-Linked Immunospot (ELISPOT) Analysis

ELISPOT analysis was performed according to ELISPOT harmonization guidelines (Janetzki et al., 2015) with the mouse IFNg ELISpotPLUS kit (MABTECH). $1 \times 10^5$ splenocytes were incubated with 10 uM of the indicated peptides for 16 hours in 96-well IFNg antibody coated plates. Spots were developed using alkaline phosphatase. The reaction was timed for 10 minutes and was quenched by running the plate under tap water. Spots were counted using an AID vSpot Reader Spectrum. For ELISPOT analysis, wells with saturation >50% were recorded as "too numerous to count". Samples with deviation of replicate wells >10% were excluded from analysis. Spot counts were then corrected for well confluency using the formula: spot count+2×(spot count×% confluence/[100%−% confluence]). Negative background was corrected by subtraction of spot counts in the negative peptide stimulation wells from the antigen stimulated wells. Finally, wells labeled too numerous to count were set to the highest observed corrected value, rounded up to the nearest hundred.

Ex Vivo Intracellular Cytokine Staining (ICS) and Flow Cytometry Analysis

Freshly isolated lymphocytes at a density of $2-5 \times 10^6$ cells/mL were incubated with 10 uM of the indicated peptides for 2 hours. After two hours, brefeldin A was added to a concentration of 5 ug/ml and cells were incubated with stimulant for an additional 4 hours. Following stimulation, viable cells were labeled with fixable viability dye eFluor780 according to manufacturer's protocol and stained with anti-CD8 APC (clone 53-6.7, BioLegend) at 1:400 dilution. Anti-IFNg PE (clone XMG1.2, BioLegend) was used at 1:100 for intracellular staining. Samples were collected on an Attune NxT Flow Cytometer (Thermo Scientific). Flow cytometry data was plotted and analyzed using FlowJo. To assess degree of antigen-specific response, both the percent IFNg+ of CD8+ cells and the total IFNg+ cell number/$1 \times 10^6$ live cells were calculated in response to each peptide stimulant.

XIV.B.2. In Vitro Evaluation of Antigen Cassette Designs

As an example of antigen cassette design evaluation, an in vitro cell-based assay was developed to assess whether selected human epitopes within model vaccine cassettes were being expressed, processed, and presented by antigen-presenting cells (FIG. 1). Upon recognition, Jurkat-Lucia reporter T cells that were engineered to express one of five TCRs specific for well-characterized peptide-HLA combinations become activated and translocate the nuclear factor of activated T cells (NFAT) into the nucleus which leads to transcriptional activation of a luciferase reporter gene. Antigenic stimulation of the individual reporter CD8 T cell lines was quantified by bioluminescence.

Individual Jurkat-Lucia reporter lines were modified by lentiviral transduction with an expression construct that includes an antigen-specific TCR beta and TCR alpha chain separated by a P2A ribosomal skip sequence to ensure equimolar amounts of translated product (Banu et al., 2014). The addition of a second CD8 beta-P2A-CD8 alpha element to the lentiviral construct provided expression of the CD8 co-receptor, which the parent reporter cell line lacks, as CD8 on the cell surface is crucial for the binding affinity to target pMHC molecules and enhances signaling through engagement of its cytoplasmic tail (Lyons et al., 2006; Yachi et al., 2006).

After lentiviral transduction, the Jurkat-Lucia reporters were expanded under puromycin selection, subjected to single cell fluorescence assisted cell sorting (FACS), and the monoclonal populations tested for luciferase expression. This yielded stably transduced reporter cell lines for specific peptide antigens 1, 2, 4, and 5 with functional cell responses. (Table 2).

TABLE 2

Development of an in vitro T cell activation assay. Peptide-specific T cell recognition as measured by induction of luciferase indicates effective processing and presentation of the vaccine cassette antigens.

| Epitope | Short Cassette Design AAY |
|---|---|
| 1 | 24.5 ± 0.5 |
| 2 | 11.3 ± 0.4 |
| 3* | n/a |

TABLE 2-continued

Development of an in vitro T cell activation assay. Peptide-specific T cell recognition as measured by induction of luciferase indicates effective processing and presentation of the vaccine cassette antigens.

| Epitope | Short Cassette Design AAY |
|---|---|
| 4 | 26.1 ± 3.1 |
| 5 | 46.3 ± 1.9 |

*Reporter T cell for epitope 3 not yet generated

In another example, a series of short cassettes, all marker epitopes were incorporated in the same position (FIG. 2A) and only the linkers separating the HLA-A*0201 restricted epitopes (FIG. 2B) were varied. Reporter T cells were individually mixed with U-87 antigen-presenting cells (APCs) that were infected with adenoviral constructs expressing these short cassettes, and luciferase expression was measured relative to uninfected controls. All four antigens in the model cassettes were recognized by matching reporter T cells, demonstrating efficient processing and presentation of multiple antigens. The magnitude of T cell responses follow largely similar trends for the natural and AAY-linkers. The antigens released from the RR-linker based cassette show lower luciferase inductions (Table 3). The DPP-linker, designed to disrupt antigen processing, produced a vaccine cassette that led to low epitope presentation (Table 3).

TABLE 3

Evaluation of linker sequences in short cassettes. Luciferase induction in the in vitro T cell activation assay indicated that, apart from the DPP-based cassette, all linkers facilitated efficient release of the cassette antigens. T cell epitope only (no linker) = 9AA, natural linker one side = 17AA, natural linker both sides = 25AA, non-natural linkers = AAY, RR, DPP

| | Short Cassette Designs | | | | | |
|---|---|---|---|---|---|---|
| Epitope | 9AA | 17AA | 25AA | AAY | RR | DPP |
| 1 | 33.6 ± 0.9 | 42.8 ± 2.1 | 42.3 ± 2.3 | 24.5 ± 0.5 | 21.7 ± 0.9 | 0.9 ± 0.1 |
| 2 | 12.0 ± 0.9 | 10.3 ± 0.6 | 14.6 ± 04 | 11.3 ± 0.4 | 8.5 ± 0.3 | 1.1 ± 0.2 |
| 3* | n/a | n/a | n/a | n/a | n/a | n/a |
| 4 | 26.6 ± 2.5 | 16.1 ± 0.6 | 16.6 ± 0.8 | 26.1 ± 3.1 | 12.5 ± 0.8 | 1.3 ± 0.2 |
| 5 | 29.7 ± 0.6 | 21.2 ± 0.7 | 24.3 ± 1.4 | 46.3 ± 1.9 | 19.7 ± 0.4 | 1.3 ± 0.1 |

*Reporter T cell for epitope 3 not yet generated

Figure 3:
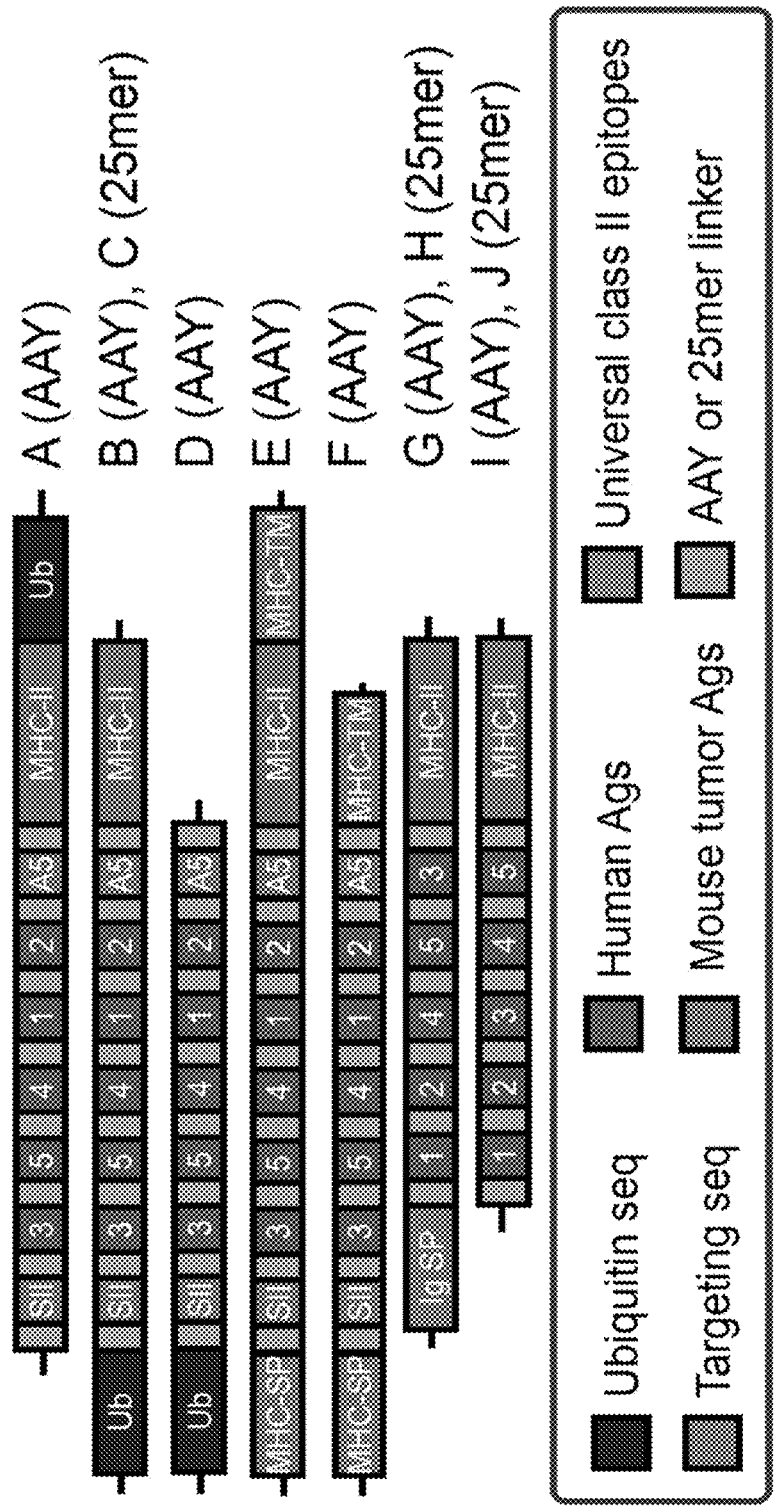
FIG. 3 illustrates evaluation of cellular targeting sequences added to model vaccine cassettes. The targeting cassettes extend the short cassette designs with ubiquitin (Ub), signal peptides (SP) and/or transmembrane (TM) domains, feature next to the five marker human T cell epitopes (epitopes 1 through 5) also two mouse T cell epitopes SIINFEKL (SII) (SEQ ID NO: 72) and SPSYAYHQF (A5) (SEQ ID NO: 73), and use either the non-natural linker AAY- or natural linkers flanking the T cell epitopes on both sides (25mer).

In another example, an additional series of short cassettes were constructed that, besides human and mouse epitopes, contained targeting sequences such as ubiquitin (Ub), MHC and Ig-kappa signal peptides (SP), and/or MHC transmembrane (TM) motifs positioned on either the N- or C-terminus of the cassette. (FIG. 3). When delivered to U-87 APCs by adenoviral vector, the reporter T cells again demonstrated efficient processing and presentation of multiple cassette-derived antigens. However, the magnitude of T cell responses were not substantially impacted by the various targeting features (Table 4).

TABLE 4

Evaluation of cellular targeting sequences added to model vaccine cassettes. Employing the in vitro T cell activation assay demonstrated that the four HLA-A*0201 restricted marker epitopes are liberated efficiently from the model cassettes and targeting sequences did not substantially improve T cell recognition and activation.

| | Short Cassette Designs | | | | | | | | | |
|---|---|---|---|---|---|---|---|---|---|---|
| Epitope | A | B | C | D | E | F | G | H | I | J |
| 1 | 32.5 ± 1.5 | 31.8 ± 0.8 | 29.1 ± 1.2 | 29.1 ± 1.1 | 28.4 ± 0.7 | 20.4 ± 0.5 | 35.0 ± 1.3 | 30.3 ± 2.0 | 22.5 ± 0.9 | 38.1 ± 1.6 |
| 2 | 6.1 ± 0.2 | 6.3 ± 0.2 | 7.6 ± 0.4 | 7.0 ± 0.5 | 5.9 ± 0.2 | 3.7 ± 0.2 | 7.6 ± 0.4 | 5.4 ± 0.3 | 6.2 ± 0.4 | 6.4 ± 0.3 |
| 3* | n/a | n/a | n/a | n/a | n/a | n/a | n/a | n/a | n/a | n/a |
| 4 | 12.3 ± 1.1 | 14.1 ± 0.7 | 12.2 ± 0.8 | 13.7 ± 1.0 | 11.7 ± 0.8 | 10.6 ± 0.4 | 11.0 ± 0.6 | 7.6 ± 0.6 | 16.1 ± 0.5 | 8.7 ± 0.5 |
| 5 | 44.4 ± 2.8 | 53.6 ± 1.6 | 49.9 ± 3.3 | 50.5 ± 2.8 | 41.7 ± 2.8 | 36.1 ± 1.1 | 46.5 ± 2.1 | 31.4 ± 0.6 | 75.4 ± 1.6 | 35.7 ± 2.2 |

*Reporter T cell for epitope 3 not yet generated

XIV.B.3. In Vivo Evaluation of Antigen Cassette Designs

Figures 2A, 2B:
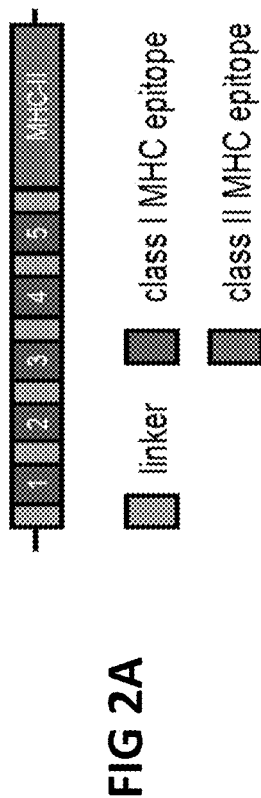
FIG. 2A illustrates evaluation of linker sequences in short cassettes and shows five class I MHC restricted epitopes (epitopes 1 through 5) concatenated in the same position relative to each other followed by two universal class II MHC epitopes (MHC-II). Various iterations were generated using different linkers. In some cases the T cell epitopes are directly linked to each other. In others, the T cell epitopes are flanked on one or both sides by its natural sequence. In other iterations, the T cell epitopes are linked by the non-natural sequences AAY, RR, and DPP.
FIG. 2B illustrates evaluation of linker sequences in short cassettes and shows sequence information on the T cell epitopes embedded in the short cassettes.
Figure 4:
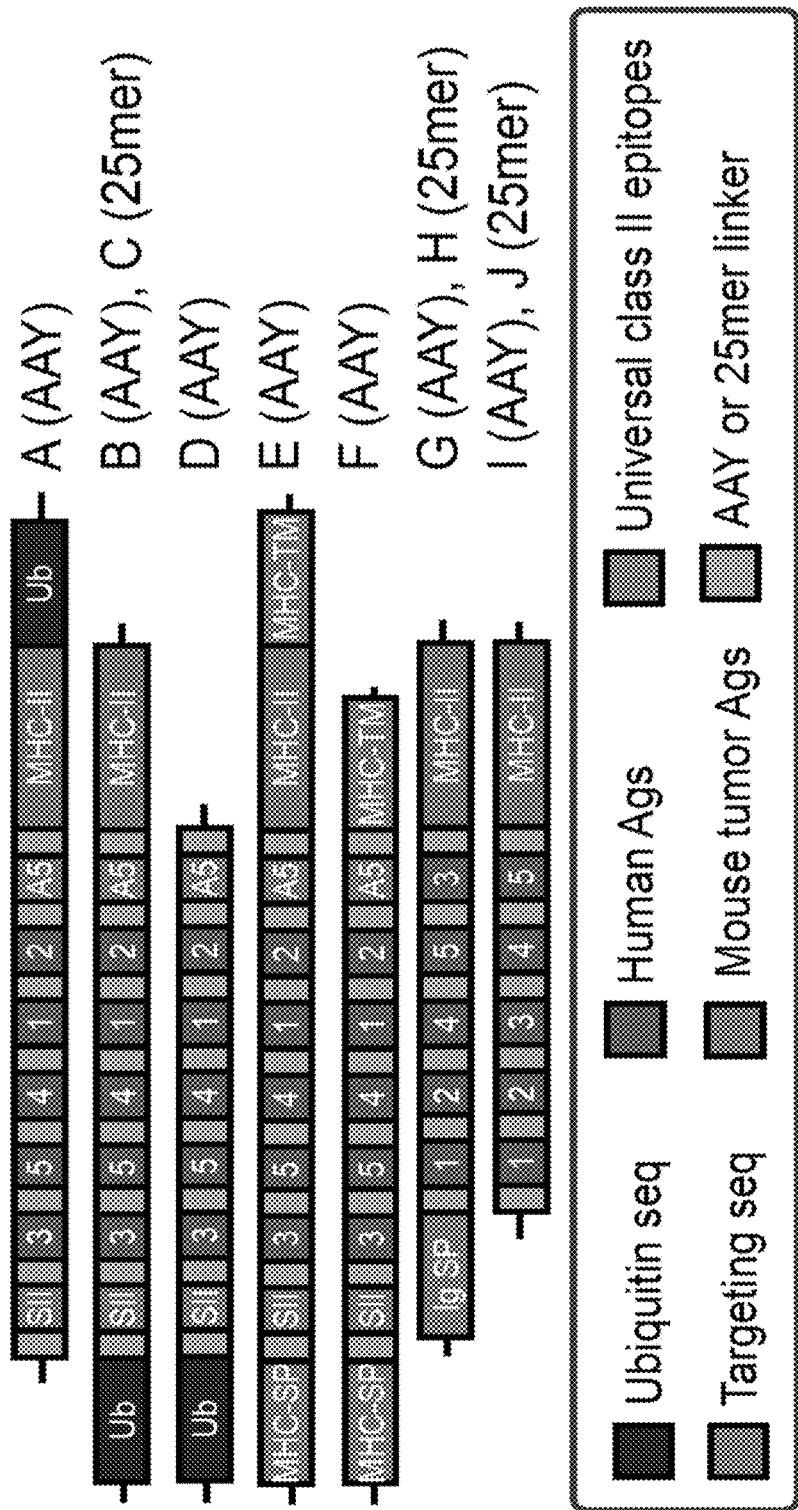
FIG. 4 illustrates in vivo evaluation of linker sequences in short cassettes. A) Experimental design of the in vivo evaluation of vaccine cassettes using HLA-A2 transgenic mice.
Figure 5A:
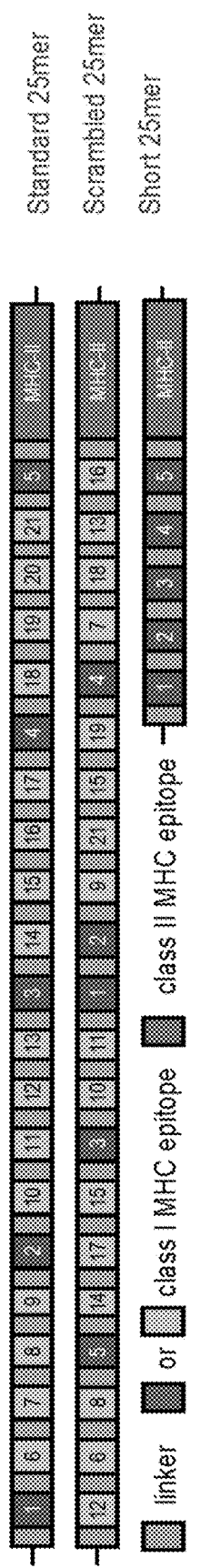
FIG. 5A illustrates in vivo evaluation of the impact of epitope position in long 21-mer cassettes and shows the design of long cassettes entails five marker class I epitopes (epitopes 1 through 5) contained in their 25-mer natural sequence (linker=natural flanking sequences), spaced with additional well-known T cell class I epitopes (epitopes 6 through 21) contained in their 25-mer natural sequence, and two universal class II epitopes (MHC-110, with only the relative position of the class I epitopes varied.

As another example of antigen cassette design evaluation, vaccine cassettes were designed to contain 5 well-characterized human class I MHC epitopes known to stimulate CD8 T cells in an HLA-A*02:01 restricted fashion (FIG. 2A, 3, 5A). For the evaluation of their in vivo immunogenicity, vaccine cassettes containing these marker epitopes were incorporated in adenoviral vectors and used to infect HLA-A2 transgenic mice (FIG. 4). This mouse model carries a transgene consisting partly of human HLA-A*0201 and mouse H2-Kb thus encoding a chimeric class I MHC molecule consisting of the human HLA-A2.1 leader, α1 and α2 domains ligated to the murine 3, transmembrane and cytoplasmic H2-Kb domain (Vitiello et al., 1991). The chimeric molecule allows HLA-A*02:01-restricted antigen presentation whilst maintaining the species-matched interaction of the CD8 co-receptor with the α3 domain on the MHC.

For the short cassettes, all marker epitopes generated a T cell response, as determined by IFN-gamma ELISPOT, that was approximately 10-50× stronger of what has been commonly reported (Cornet et al., 2006; Depla et al., 2008; Ishioka et al., 1999). Of all the linkers evaluated, the concatamer of 25mer sequences, each containing a minimal epitope flanked by their natural amino acids sequences, generated the largest and broadest T cell response (Table 5). Intracellular cytokine staining (ICS) and flow cytometry analysis revealed that the antigen-specific T cell responses are derived from CD8 T cells.

TABLE 5

In vivo evaluation of linker sequences in short cassettes. ELISPOT data indicated that HLA-A2 transgenic mice, 17 days post-infection with 1e11 adenovirus viral particles, generated a T cell response to all class I MHC restricted epitopes in the cassette.

| | Short Cassette Designs | | | | | |
|---|---|---|---|---|---|---|
| Epitope | 9AA | 17AA | 25AA | AAY | RR | DPP |
| 1 | 2020 +/− 583 | 2505 +/− 1281 | 6844 +/− 956 | 1489 +/− 762 | 1675 +/− 690 | 1781 +/− 774 |
| 2 | 4472 +/− 755 | 3792 +/− 1319 | 7629 +/− 996 | 3851 +/− 1748 | 4726 +/− 1715 | 5868 +/− 1427 |
| 3 | 5830 +/− 315 | 3629 +/− 862 | 7253 +/− 491 | 4813 +/− 1761 | 6779 +/− 1033 | 7328 +/− 1700 |
| 4 | 5536 +/− 375 | 2446 +/− 955 | 2961 +/− 1487 | 4230 +/− 1759 | 6518 +/− 909 | 7222 +/− 1824 |
| 5 | 8800 +/− 0 | 7943 +/− 821 | 8423 +/− 442 | 8312 +/− 696 | 8800 +/− 0 | 1836 +/− 328 |

In another example, a series of long vaccine cassettes was constructed and incorporated in adenoviral vectors that, next to the original 5 marker epitopes, contained an additional 16 HLA-A*02:01, A*03:01 and B*44:05 epitopes with known CD8 T cell reactivity (FIG. 5A, 5B). The size of these long cassettes closely mimicked the final clinical cassette design, and only the position of the epitopes relative to each other was varied. The CD8 T cell responses were comparable in magnitude and breadth for both long and short vaccine cassettes, demonstrating that (a) the addition of more epitopes did not substantially impact the magnitude of immune response to the original set of epitopes, and (b) the position of an epitope in a cassette did not substantially influence the ensuing T cell response to it (Table 6).

TABLE 6

In vivo evaluation of the impact of epitope position in long cassettes. ELISPOT data indicated that HLA-A2 transgenic mice, 17 days post-infection with 5e10 adenovirus viral particles, generated a T cell response comparable in magnitude for both long and short vaccine cassettes.

| Epitope | Long Cassette Designs | | Short |
|---|---|---|---|
| | Standard | Scrambled | |
| 1 | 863 +/− 1080 | 804 +/− 1113 | 1871 +/− 2859 |
| 2 | 6425 +/− 1594 | 28 +/− 62 | 5390 +/− 1357 |
| 3* | 23 +/− 30 | 36 +/− 18 | 0 +/− 48 |
| 4 | 2224 +/− 1074 | 2727 +/− 644 | 2637 +/− 1673 |
| 5 | 7952 +/− 297 | 8100 +/− 0 | 8100 +/− 0 |

*Suspected technical error caused an absence of a T cell response.

XIV.B.4. Antigen Cassette Design for Immunogenicity and Toxicology Studies

In summary, the findings of the model cassette evaluations (FIG. 2-5, Tables 2-6) demonstrated that, for model vaccine cassettes, robust immunogenicity was achieved when a "string of beads" approach was employed that encodes around 20 epitopes in the context of an adenovirus-based vector. The epitopes were assembled by concatenating 25mer sequences, each embedding a minimal CD8 T cell epitope (e.g. 9 amino acid residues) that were flanked on both sides by its natural, surrounding peptide sequence (e.g. 8 amino acid residues on each side). As used herein, a "natural" or "native" flanking sequence refers to the N- and/or C-terminal flanking sequence of a given epitope in the naturally occurring context of that epitope within its source protein. For example, the HCMV pp65 MHC I epitope NLVPMVATV (SEQ ID NO: 78) is flanked on its 5' end by the native 5' sequence WQAGILAR (SEQ ID NO: 85) and on its 3' end by the native 3' sequence QGQNLKYQ (SEQ ID NO: 86), thus generating the WQAGI-LARNLVPMVATVQGQNLKYQ (SEQ ID NO: 87) 25mer peptide found within the HCMV pp65 source protein. The natural or native sequence can also refer to a nucleic acid sequence that encodes an epitope flanked by native flanking sequence(s). Each 25mer sequence is directly connected to the following 25mer sequence. In instances where the minimal CD8 T cell epitope is greater than or less than 9 amino acids, the flanking peptide length can be adjusted such that the total length is still a 25mer peptide sequence. For example, a 10 amino acid CD8 T cell epitope can be flanked by an 8 amino acid sequence and a 7 amino acid. The concatamer was followed by two universal class II MHC epitopes that were included to stimulate CD4 T helper cells and improve overall in vivo immunogenicity of the vaccine cassette antigens. (Alexander et al., 1994; Panina-Bordignon et al., 1989) The class II epitopes were linked to the final class I epitope by a GPGPG amino acid linker (SEQ ID NO:56). The two class II epitopes were also linked to each other by a GPGPG amino acid linker (SEQ ID NO: 56), as a well as flanked on the C-terminus by a GPGPG amino acid linker (SEQ ID NO: 56). Neither the position nor the number of epitopes appeared to substantially impact T cell recognition or response. Targeting sequences also did not appear to substantially impact the immunogenicity of cassette-derived antigens.

Figure 6A:
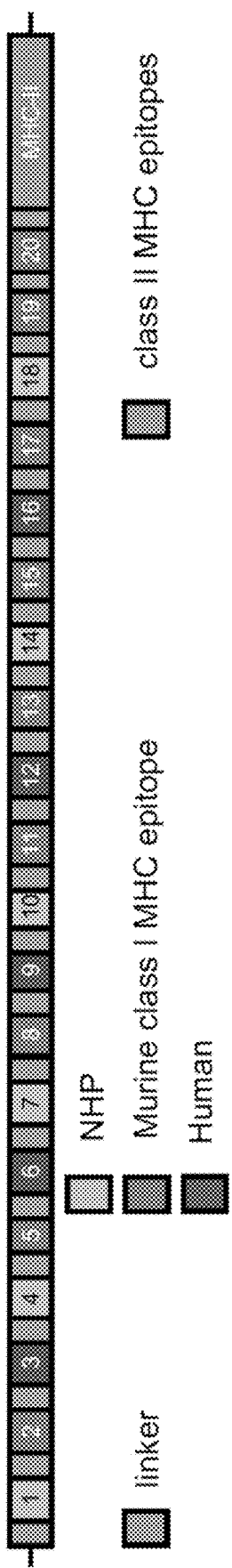
FIG. 6A illustrates final cassette design for preclinical IND-enabling studies and shows the design of the final cassettes comprises 20 MHC I epitopes contained in their 25-mer natural sequence (linker=natural flanking sequences), composed of 6 non-human primate (NHP) epitopes, 5 human epitopes, 9 murine epitopes, as well as 2 universal MHC class II epitopes.

As a further example, based on the in vitro and in vivo data obtained with model cassettes (FIG. 2-5, Tables 2-6), a cassette design was generated that alternates well-characterized T cell epitopes known to be immunogenic in non-human primates (NHPs), mice and humans. The 20 epitopes, all embedded in their natural 25mer sequences, are followed by the two universal class II MHC epitopes that were present in all model cassettes evaluated (FIG. 6). This cassette design was used to study immunogenicity as well as pharmacology and toxicology studies in multiple species.

XIV.B.5. Antigen Cassette Design and Evaluation for 30, 40, and 50 Antigens

Figure 29:
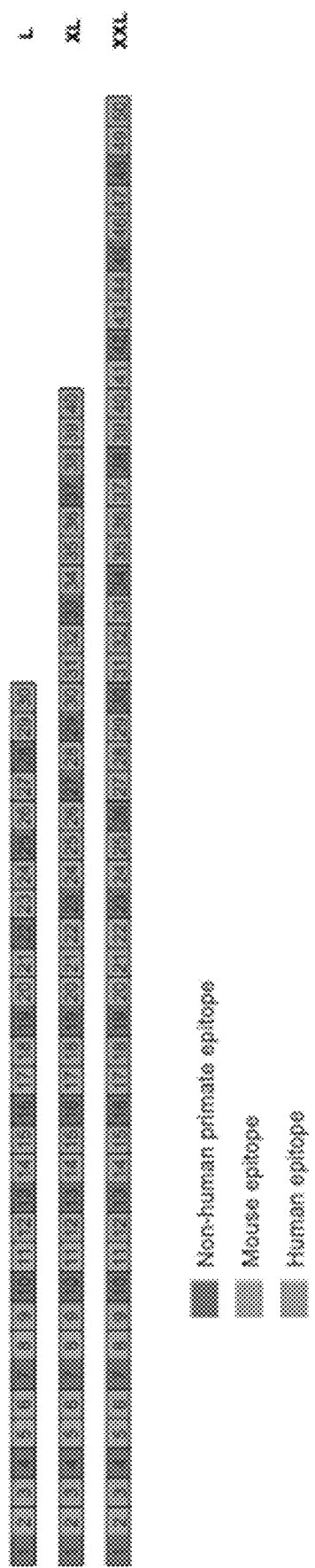
FIG. 29 illustrates the general organization of the model epitopes from the various species for large antigen cassettes that had either 30 (L), 40 (XL) or 50 (XXL) epitopes.

Large antigen cassettes were designed that had either 30 (L), 40 (XL) or 50 (XXL) epitopes, each 25 amino acids in length. The epitopes were a mix of human, NHP and mouse epitopes to model disease antigens including tumor antigens. FIG. 29 illustrates the general organization of the epitopes from the various species. The model antigens used are described in Tables 32, 33 and 34 for human, primate, and mouse model epitopes, respectively. Each of Tables 32, 33 and 34 described the epitope position, name, minimal epitope description, and MHC class.

Figure 30:
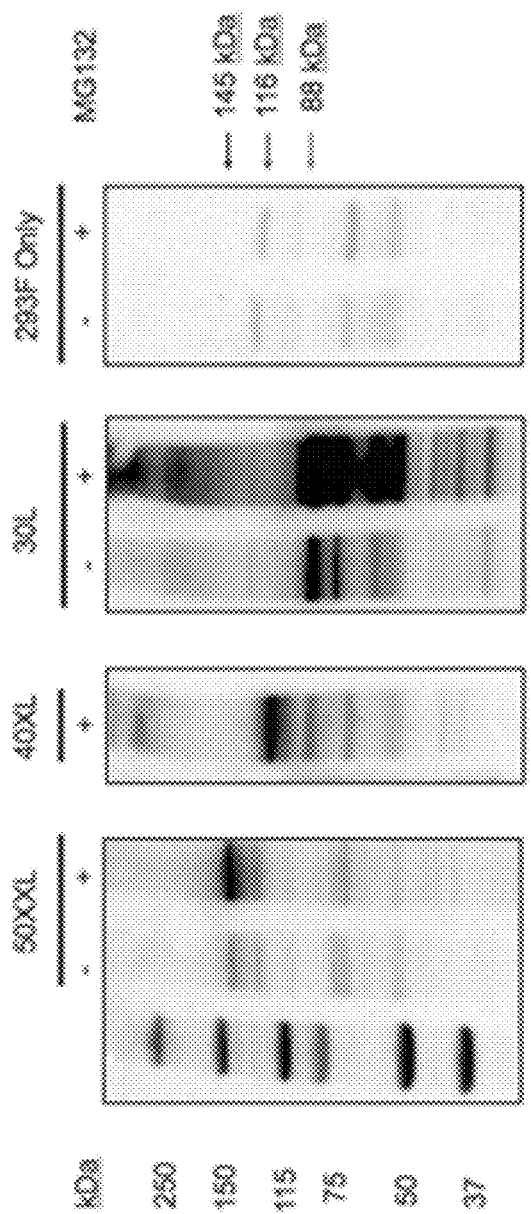
FIG. 30 shows ChAd vectors express long cassettes as indicated by the above Western blot using an anti-class II (PADRE) antibody that recognizes a sequence common to all cassettes. HEK293 cells were infected with ChAdV68 vectors expressing large cassettes (ChAdV68-50XXL, ChAdV68-40XL & ChAdV68-30L) of variable size. Infections were set up at a MOI of 0.2. Twenty-four hours post infection MG132 a proteasome inhibitor was added to a set of the infected wells (indicated by the plus sign). Another set of virus treated wells were not treated with MG132 (indicated by minus sign). Uninfected HEK293 cells (293F) were used as a negative control. Forty-eight hours post infection cell pellets were harvested and analyzed by SDS/PAGE electrophoresis, and immunoblotting using a rabbit anti-Class II PADRE antibody. A HRP anti-rabbit antibody and ECL chemiluminescent substrate was used for detection.

These cassettes were cloned into the ChAdV68 and alphavirus vaccine vectors as described to evaluate the efficacy of longer multiple-epitope cassettes. FIG. 30 shows that each of the large antigen cassettes were expressed from a ChAdV vector as indicated by at least one major band of the expected size by Western blot.

Figure 31:
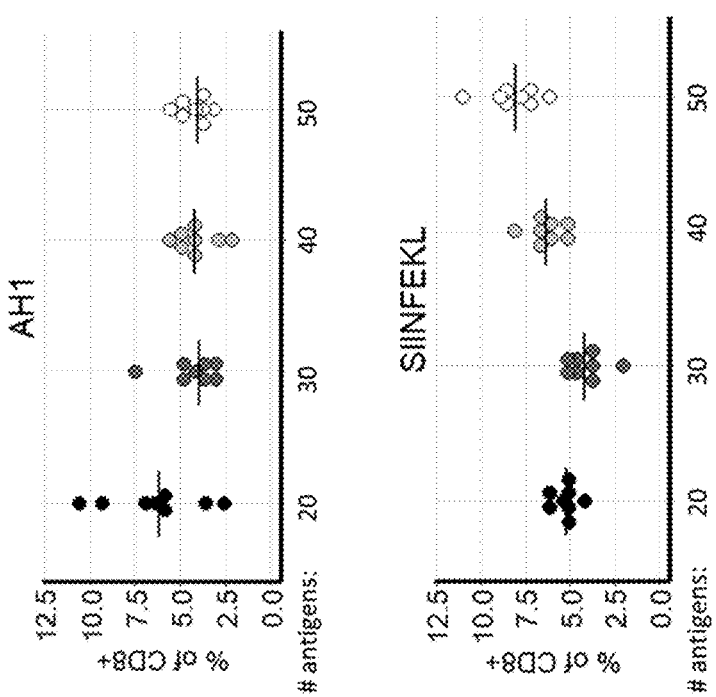
FIG. 31 shows CD8+ immune responses in ChAdV68 large cassette immunized mice, detected against AH1 (top) and SIINFEKL (SEQ ID NO: 72) (bottom) by ICS. Data is presented as IFNg+ cells against the model epitope as % of total CD8 cells
Figure 32:
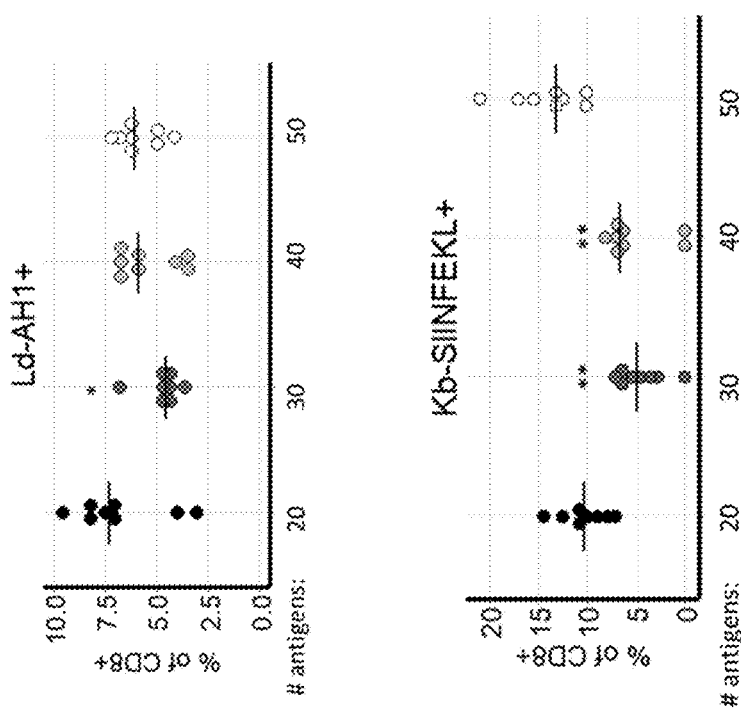
FIG. 32 shows CD8+ responses to LD-AH1+(top) and Kb-SIINFEKL+ (bottom) ("SIINFEKL" disclosed as SEQ ID NO: 72) Tetramers post ChAdV68 large cassette vaccination. Data is presented as % of total CD8 cells reactive against the model Tetramer peptide complex. *p<0.05, **p<0.01 by ANOVA with Tukey's test. All p-values compared to MAG 20-antigen cassette.
Figure 33:
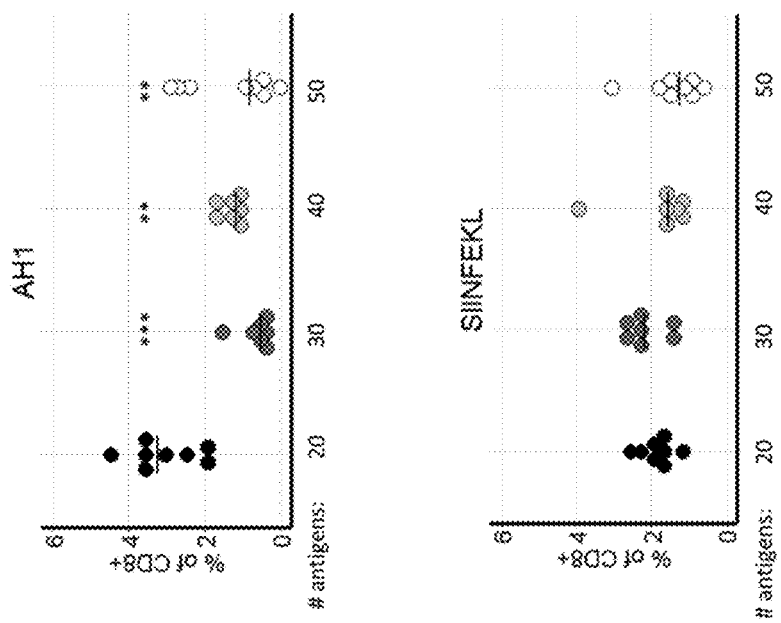
FIG. 33 shows CD8+ immune responses in alphavirus large cassette treated mice, detected against AH1 (top) and SIINFEKL (SEQ ID NO: 72) (bottom) by ICS. Data is presented as IFNg+ cells against the model epitope as % of total CD8 cells. *p<0.05, p<0.01, *p<0.001 by ANOVA with Tukey's test. All p-values compared to MAG 20-antigen cassette.

Mice were immunized as described to evaluate the efficacy of the large cassettes. T cell responses were analyzed by ICS and tetramer staining following immunization with a ChAdV68 vector (FIG. 31/Table 35 and FIG. 32/Table 36, respectively) and by ICS following immunization with a srRNA vector (FIG. 33/Table 37) for epitopes AH1 (top panels) and SIINFEKL (SEQ ID NO: 72) (bottom panels). Immunizations using ChAdV68 and srRNA vaccine vectors expressing either 30 (L), 40 (XL) or 50 (XXL) epitopes induced CD8+ immune responses to model disease epitopes.

TABLE 32

Human epitopes in large cassettes (Table 32 discloses SEQ ID NOS 80-82, 78-79, 88-100, 87 and 101-111, respectively, in order of columns)

| Epitope position in each cassette | | | | | | | | | |
|---|---|---|---|---|---|---|---|---|---|
| L | XL | XXL | Name | Minimal epitope | 25 mer | MHC | Restriction | Strain | Species |
| 3 | 3 | 3 | 5.influenza | MGILGFVFTL | PILSPLTKGILGFVFTLTVPSERGL | Class I | A*02:01 | Human | Human |
| 6 | 6 | 6 | 4.HTLV-1 Tax | LLFGYPVYV | HFPGFGQSLLFGYPVYVFGDCVQGD | Class I | A*02:01 | Human | Human |
| 9 | 9 | 9 | 3.EBV BMLF1 | GLCTLVAML | RMQAIQNAGLCTLVAMLEETIFWLQ | Class I | A*02:01 | Human | Human |
| 12 | 12 | 12 | 1.HCMV pp65 | NLVPMVATV | WQAGILARNLVPMVATVQGQNLKYQ | Class I | A*02:01 | Human | Human |
| 15 | 15 | 15 | 2.EBV LMP2A | CLGGLLTMV | RTYGPVFMCLGGLLTMVAGAVWLTV | Class I | A*02:01 | Human | Human |
| 18 | 18 | 18 | CT83 | NTDNNLAVY | SSSGLINSNTDNNLAVYDLSRDILN | Class I | A*01:01 | Human | Human |
|  | 21 | 21 | MAGEA6 | EVDPIGHVY | LVEGIELMEVDPIGHVYIFATCLGL | Class I | B*35:01 | Human | Human |
| 21 | 25 | 25 | CT83 | LLASSILCA | MNFYLLLASSILCALIVFWKYRRFQ | Class I | A*02:01 | Human | Human |
| 24 | 31 | 28 | FOXE1 | AIFPGAVPAA | AAAAAAAAIFPGAVPAARPPYPGAV | Class I | A*02:01 | Human | Human |
| 27 | 35 | 32 | CT83 | VYDLSRDIL | SNTDNNLAVYDLSRDILNNFPHSIA | Class I | A*24:02 | Human | Human |
|  | 38 | 36 | MAGE3/6 | ASSLPTTMNY | DPPQSPQGASSLPTTMNYPLWSQSY | Class I | A*01:01 | Human | Human |
| 30 | 40 | 40 | Influenza HA | PKYVKQNTLKLAT | ITYGACPKYVKQNTLKLATGMRNVP | Class II | DRB1*0101 | Human | Human |
|  |  | 44 | CMV pp65 | LPLKMLNIPSINVH | SIYVYALPLKMLNIPSINVHHYPSA | Class II | DRB1*0101 | Human | Human |
|  |  | 47 | EBV EBNA3A | PEQWMFQGAPPSQGTEGP | WVPEQWMFQGAPPSQGTDVVQH | Class II | DRB1*0102 | Human | Human |
|  |  | 50 | CMV pp65 | EHPTFTSQYRIQGKLRGP | QYSEHPTFTSQYRIQGKLEYRH | Class II | DRB1*1101 | Human | Human |

TABLE 33

NHP epitopes in large cassettes (Table 33 discloses SEQ ID NOS 112-141, respectively, in order of columns)

| Epitope position in each cassette | | | | epitope | | | | | |
|---|---|---|---|---|---|---|---|---|---|
| L | XL | XXL | Name | Minimal | 25 mer | MHC | Restriction | Strain | Species |
| 1 | 1 | 1 | Gag CM9 | CTPYDINQM | MFQALSEGCTPYDINQMLNVLGDHQ | Class I | Mamu-A*01 | Rhesus | NHP |
| 4 | 4 | 4 | Tat TL8 | TTPESANL | SCISEADATTPESANLGEEILSQLY | Class I | Mamu-A*01 | Rhesus | NHP |
| 7 | 7 | 7 | Env CL9 | CAPPGYALL | WDAIRFRYCAPPGYALLRCNDTNYS | Class I | Mamu-A*01 | Rhesus | NHP |
| 10 | 10 | 10 | Pol SV9 | SGPKTNIIV | AFLMALTDSGPKTNIIVDSQYVMGI | Class I | Mamu-A*01 | Rhesus | NHP |
| 13 | 13 | 13 | Gag LW9 | LSPRTLNAW | GNVWVHTPLSPRTLNAWVKAVEEKK | Class I | Mamu-A*01 | Rhesus | NHP |
|  |  | 16 | Env_TL9 | TVPWPNASL | AFRQVCHTTVPWPNASLTPKWNNET | Class I | Mamu-A*01 | Rhesus | NHP |
| 16 | 16 | 19 | Ag856 | PNGTHSWEYWGAQLN | VFNFPPNGTHSWEYWGAQLNAMKGD | Class II | Mamu-DR*W | Rhesus | NHP |
| 19 | 19 | 23 | HIV-1 Env | YKYKVVKIEPLGV | NWRSELYKYKVVKIEPLGVAPTKAK | Class II | Mamu-DR*W | Rhesus | NHP |
|  |  | 26 | Gag TE15 | TEEAKQIVQRHLVVE | EKVKHTEEAKQIVQRHLVVETGTTE | Class II | Mamu-DRB* | Rhesus | NHP |

TABLE 33 -continued

NHP epitopes in large cassettes (Table 33 discloses SEQ ID NOS 112-141, respectively, in order of columns)

| Epitope position in each cassette | | | | | | | | | |
|---|---|---|---|---|---|---|---|---|---|
| L | XL | XXL | Name | epitope Minimal | 25 mer | MHC | Restriction | Strain | Species |
|  | 23 | 30 | CFP-10 36-48 | AGSLQGQWRGAAG | DQVESTAGSLQGQ WRGAAGTAAQAA | Class II | Mafa-DRB1* | Cyno | NHP |
|  | 27 | 34 | CFP-10 71-86 | EISTNIRQAGVQY SRA | QELDEISTNIRQA GVQYSRADEEQQ | Class II | Mafa-DRB1* | Cyno | NHP |
| 22 | 29 | 38 | Env 338-346 | RPKQAWCWF | FHSQPINERPKQA WCWEGGSWKEAI | Class I | Mafa-A1*063 | Cyno | NHP |
| 25 | 33 | 42 | Nef 103-111 | RPKVPLRTM | DDIDEEDDDLVGV SVRPKVPLRTMS | Class I | Mafa-A1*063 | Cyno | NHP |
| 28 | 37 | 45 | Gag 386-394 | GPRKPIKCW | PFAAAQQRGPRKP IKCWNCGKEGHS | Class I | Mafa-A1*063 | Cyno | NHP |
|  |  | 48 | Nef LT9 | LNMADKKET | RRLTARGLLNMAD KKETRTPKKAKA | Class I | Mafa-B*1043 | Cyno | NHP |

TABLE 34

Mouse epitopes in large cassettes (Table 34 discloses SEQ ID NOS 72, 142-144, 73, 145-161, 75-76 and 162-177, respectively, in order of columns)

| Epitopes in large cassettes | | | | Minimal | | | | | |
|---|---|---|---|---|---|---|---|---|---|
| L | XL | XXL | Name | epitope | 25 mer | MHC | Restriction | Strain | Species |
| 2 | 2 | 2 | OVA257 | SIINFEKL | VSGLEQLESIINF EKLTEWTSSNVM | Class I | H2-Kb | B6 | Mouse |
|  |  | 5 | B16-EGP | EGPRNQDWL | ALLAVGALEGPRN QDWLGVPRQLVT | Class I | H2-Db | B6 | Mouse |
|  |  | 8 | B16-TRP1 455-463 | TAPDNLGYM | VTNTEMFVTAPDN LGYMYEVQWPGQ | Class I | H2-Db | B6 | Mouse |
|  |  | 11 | Trp2180-188 | SVYDFFVWL | TQPQIANCSVYDF FVWLHYYSVRDT | Class I | H2-Kb | B6 | Mouse |
| 5 | 5 | 14 | CT26 AH1-A5 | SPSYAYHQF | LWPRVTYHSPSYA YHQFERRAKYKR | Class I | H2-Ld | Balb/C | Mouse |
|  | 8 | 17 | CT26 AH1-39 | MNKYAYHML | LWPRVTYHMNKYA YHMLERRAKYKR | Class I | H2-Ld | Balb/C | Mouse |
|  | 11 | 20 | MC38 Dpagt1 | SIIVFNLL | GQSLVISASIIVF NLLELEGDYRDD | Class I | H2-Kb | B6 | Mouse |
|  | 14 | 22 | MC38 Adpgk | ASMTNMELM | GIPVHLELASMTN MELMSSIVHQQV | Class I | H2-Db | B6 | Mouse |
|  | 17 | 24 | MC38 Reps1 | AQLANDVVL | RVLELFRAAQLAN DVVLQIMELCGA | Class I | H2-Db | B6 | Mouse |
| 8 | 20 | 27 | P815 P1A 35-44 | LPYLGWLVF | HRYSLEEILPYLG WLVFAVVTTSFL | Class I | H2-Ld | DBA/2 | Mouse |
| 11 | 22 | 29 | P815 P1E | GYCGLRGTGVYLSKNPDGYCGLR | GTGVSCPMAIKK | Class I | H2-Kd | DBA/2 | Mouse |
| 14 | 24 | 31 | Panc02 Mesothelin | LSIFKHKL | NEIPFTYEQLSIF KHKLDKTYPQGY | Class I | H2-Kb | B6 | Mouse |
| 17 | 26 | 33 | Panc02 Mesothelin | LIWIPALL | SRASLLGPGFVLI WIPALLPALRLS | Class I | H2-Kb | B6 | Mouse |

TABLE 34-continued

Mouse epitopes in large cassettes (Table 34 discloses SEQ ID NOS 72, 142-144, 73, 145-161, 75-76 and 162-177, respectively, in order of columns)

| Epitopes in large cassettes | | | | Minimal | | | | | |
|---|---|---|---|---|---|---|---|---|---|
| L | XL | XXL | Name | epitope | 25 mer | MHC | Restriction | Strain | Species |
| 20 | 28 | 35 | ID8 FRa 161-169 | SSGHNECPV | NWHKGWNWSSGHN ECPVGASCHPFT | Class I | H2-Kb | B6 | Mouse |
| 23 | 30 | 37 | ID8 Mesothelin 400 | GQKMNAQAI | KTLLKVSKGQKMN AQAIALVACYLR | Class I | H2-Db | B6 | Mouse |
| 26 | 32 | 39 | OVA-II | ISQAVHAAH AEINEAGR | ESLKISQAVHAAH AEINEAGREVVG | Class II | I-Ab, I-Ad | B6 | Mouse |
| 29 | 34 | 41 | ESAT-6 | MTEQQWNFAGM IEAAASAIQ | TEQQWNFAGIEA AASAIQGNVTSI | Class II | I-Ab | B6 | Mouse |
|  | 36 | 43 | TT p30 | FNNFTVSFWLD RVPKVSASHL | MFNNFTVSFWLR VPKVSASHLEQY | Class II | I-Ad | Balb/C | Mouse |
|  | 39 | 46 | HEL | DGSTDYGILQT INSRW | NRNTDGSTDYGI LQINSRWWCNDG | Class II | I-Ak | CBA | Mouse |
|  |  | 49 | MOG | MEVGWYRSPFT SRVVHLYRN | GMEVGWYRSPFS RVVHLYRNGKDQ | Class II | I-Ab | B6 | Mouse |

TABLE 35

Average IFNg+ cells in response to AH1 and SIINFEKL (SEQ ID NO: 72) peptides in ChAd large cassette treated mice. Data is presented as % of total CD8 cells. Shown is average and standard deviation per group and p-value by ANOVA with Tukey's test. All p-values compared to MAG 20-antigen cassette.

| # antigens | Antigen | Average | Standard deviation | p-value | N |
|---|---|---|---|---|---|
| 20 | SIINFEKL (SEQ ID NO: 72) | 5.308 | 0.660 | n/a | 8 |
| 30 | SIINFEKL (SEQ ID NO: 72) | 4.119 | 1.019 | 0.978 | 8 |
| 40 | SIINFEKL (SEQ ID NO: 72) | 6.324 | 0.954 | 0.986 | 8 |
| 50 | SIINFEKL (SEQ ID NO: 72) | 8.169 | 1.469 | 0.751 | 8 |
| 20 | AH1 | 6.405 | 2.664 | n/a | 8 |
| 30 | AH1 | 4.373 | 1.442 | 0.093 | 8 |
| 40 | AH1 | 4.126 | 1.135 | 0.050 | 8 |
| 50 | AH1 | 4.216 | 0.808 | 0.063 | 8 |

TABLE 36

Average tetramer+ cells for AH1 and SIINFEKL (SEQ ID NO: 72) antigens in ChAd large cassette treated mice. Data is presented as % of total CD8 cells. Shown is average and standard deviation per group and p-value by ANOVA with Tukey's test. All p-values compared to MAG 20-antigen cassette.

| # antigens | Antigen | Average | Standard deviation | p-value | N |
|---|---|---|---|---|---|
| 20 | SIINFEKL (SEQ ID NO: 72) | 10.314 | 2.384 | n/a | 8 |
| 30 | SIINFEKL (SEQ ID NO: 72) | 4.551 | 2.370 | 0.003 | 8 |
| 40 | SIINFEKL (SEQ ID NO: 72) | 5.186 | 3.254 | 0.009 | 8 |
| 50 | SIINFEKL (SEQ ID NO: 72) | 14.113 | 3.660 | 0.072 | 8 |
| 20 | AH1 | 6.864 | 2.207 | n/a | 8 |
| 30 | AH1 | 4.713 | 0.922 | 0.036 | 8 |
| 40 | AH1 | 5.393 | 1.452 | 0.223 | 8 |
| 50 | AH1 | 5.860 | 1.041 | 0.543 | 8 |

TABLE 37

Average IFNg+ cells in response to AH1 and
SIINFEKL (SEQ ID NO: 72) peptides in
SAM large cassette treated mice.
Data is presented as % of total
CD8 cells. Shown is average and standard
deviation per group and p-value by ANOVA
with Tukey's test. All p-values compared
to MAG 20-antigen cassette.

| # antigens | Antigen | Average | Standard deviation | p-value | N |
|---|---|---|---|---|---|
| 20 | SIINFEKL (SEQ ID NO: 72) | 1.843 | 0.422 | n/a | 8 |
| 30 | SIINFEKL (SEQ ID NO: 72) | 2.112 | 0.522 | 0.879 | 7 |
| 40 | SIINFEKL (SEQ ID NO: 72) | 1.754 | 0.978 | 0.995 | 7 |
| 50 | SIINFEKL (SEQ ID NO: 72) | 1.409 | 0.766 | 0.606 | 8 |
| 20 | AH1 | 3.050 | 0.909 | n/a | 8 |
| 30 | AH1 | 0.618 | 0.427 | 1.91E-05 | 7 |
| 40 | AH1 | 1.286 | 0.284 | 0.001 | 7 |
| 50 | AH1 | 1.309 | 1.149 | 0.001 | 8 |

XV. ChAd Antigen Cassette Delivery Vector

XV.A. ChAd Antigen Cassette Delivery Vector Construction

In one example, Chimpanzee adenovirus (ChAd) was engineered to be a delivery vector for antigen cassettes. In a further example, a full-length ChAdV68 vector was synthesized based on AC_000011.1 (sequence 2 from U.S. Pat. No. 6,083,716) with E1 (nt 457 to 3014) and E3 (nt 27,816-31,332) sequences deleted. Reporter genes under the control of the CMV promoter/enhancer were inserted in place of the deleted E1 sequences. Transfection of this clone into HEK293 cells did not yield infectious virus. To confirm the sequence of the wild-type C68 virus, isolate VR-594 was obtained from the ATCC, passaged, and then independently sequenced (SEQ ID NO:10). When comparing the AC_000011.1 sequence to the ATCC VR-594 sequence (SEQ ID NO:10) of wild-type ChAdV68 virus, 6 nucleotide differences were identified. In one example, a modified ChAdV68 vector was generated based on AC_000011.1, with the corresponding ATCC VR-594 nucleotides substituted at five positions (ChAdV68.5WTnt SEQ ID NO:1).

In another example, a modified ChAdV68 vector was generated based on AC_000011.1 with E1 (nt 577 to 3403) and E3 (nt 27,816-31,332) sequences deleted and the corresponding ATCC VR-594 nucleotides substituted at four positions. A GFP reporter (ChAdV68.4WTnt.GFP; SEQ ID NO:11) or model neoantigen cassette (ChAdV68.4WTnt.MAG25mer; SEQ ID NO:12) under the control of the CMV promoter/enhancer was inserted in place of deleted E1 sequences.

In another example, a modified ChAdV68 vector was generated based on AC_000011.1 with E1 (nt 577 to 3403) and E3 (nt 27,125-31,825) sequences deleted and the corresponding ATCC VR-594 nucleotides substituted at five positions. A GFP reporter (ChAdV68.5WTnt.GFP; SEQ ID NO:13) or model neoantigen cassette (ChAdV68.5WTnt.MAG25mer; SEQ ID NO:2) under the control of the CMV promoter/enhancer was inserted in place of deleted E1 sequences.

Relevant vectors are described below:

Full-Length ChAdVC68 sequence "ChAdV68.5WTnt" (SEQ ID NO:1); AC_000011.1 sequence with corresponding ATCC VR-594 nucleotides substituted at five positions.

ATCC VR-594 C68 (SEQ ID NO:10); Independently sequenced; Full-Length C68

ChAdV684WTnt.GFP (SEQ ID NO:11); AC_000011.1 with E1 (nt 577 to 3403) and E3 (nt 27,816-31,332) sequences deleted; corresponding ATCC VR-594 nucleotides substituted at four positions; GFP reporter under the control of the CMV promoter/enhancer inserted in place of deleted E1

ChAdV68.WTnt.MAG25mer (SEQ ID NO:12); AC_000011.1 with E1 (nt 570 to 3403) and E3 (nt 27,816-31,332) sequences deleted; corresponding ATCC VR-594 nucleotides substituted at four positions; model neoantigen cassette under the control of the CMV promoter/enhancer inserted in place of deleted E1

CbAdV68.5WTnt.GFP (SEQ ID NO: 13); AC_000011.1 with E1 (nt 577 to 3403) and E3 (nt 27,125-31,825) sequences deleted; corresponding ATCC VR-594 nucleotides substituted at five positions; GFP reporter under the control of the CMV promoter/enhancer inserted in place of deleted E1

XV.B. ChAd Antigen Cassette Delivery Vector Testing

XV.B.1. ChAd Vector Evaluation Methods and Materials

Transfection of HEK293A Cells Using Lipofectamine

DNA for the ChAdV68 constructs (ChAdV68.4WTnt.GFP, ChAdV68.5WTnt.GFP, ChAdV68.4WTnt.MAG25mer and ChAdV68.5WTnt.MAG25mer) was prepared and transfected into HEK293A cells using the following protocol.

10 ug of plasmid DNA was digested with PacI to liberate the viral genome. DNA was then purified using GeneJet DNA cleanup Micro columns (Thermo Fisher) according to manufacturer's instructions for long DNA fragments, and eluted in 20 ul of pre-heated water; columns were left at 37 degrees for 0.5-1 hours before the elution step.

HEK293A cells were introduced into 6-well plates at a cell density of $10^6$ cells/well 14-18 hours prior to transfection. Cells were overlaid with 1 ml of fresh medium (DMEM-10% hiFBS with pen/strep and glutamate) per well. 1-2 ug of purified DNA was used per well in a transfection with twice the ul volume (2-4 ul) of Lipofectamine2000, according to the manufacturer's protocol. 0.5 ml of OPTI-MEM medium containing the transfection mix was added to the 1 ml of normal growth medium in each well, and left on cells overnight.

Transfected cell cultures were incubated at 37° C. for at least 5-7 days. If viral plaques were not visible by day 7 post-transfection, cells were split 1:4 or 1:6, and incubated at 37° C. to monitor for plaque development. Alternatively, transfected cells were harvested and subjected to 3 cycles of freezing and thawing and the cell lysates were used to infect HEK293A cells and the cells were incubated until virus plaques were observed.

Transfection of ChAdV68 Vectors into HEK293A Cells Using Calcium Phosphate and Generation of the Tertiary Viral Stock DNA for the ChAdV68 constructs (ChAdV68.4WTnt.GFP, ChAdV68.5WTnt.GFP, ChAdV68.4WTnt.MAG25mer, ChAdV68.5WTnt.MAG25mer) was prepared and transfected into HEK293A cells using the following protocol.

HEK293A cells were seeded one day prior to the transfection at $10^6$ cells/well of a 6 well plate in 5% BS/DMEM/ 1XP/S, 1×Glutamax. Two wells are needed per transfection. Two to four hours prior to transfection the media was changed to fresh media. The ChAdV68.4WTnt.GFP plasmid was linearized with PacI. The linearized DNA was then phenol chloroform extracted and precipitated using one tenth volume of 3M Sodium acetate pH 5.3 and two volumes of 100% ethanol. The precipitated DNA was pelleted by centrifugation at 12,000×g for 5 min before washing 1× with 70% ethanol. The pellet was air dried and re-suspended in 50 µL of sterile water. The DNA concentration was determined using a NanoDrop™ (ThermoFisher) and the volume adjusted to 5 µg of DNA/50 µL.

169 µL of sterile water was added to a microfuge tube. 5 µL of 2M $CaCl_2$ was then added to the water and mixed gently by pipetting. 50 µL of DNA was added dropwise to the $CaCl_2$) water solution. Twenty six µL of 2M $CaCl_2$) was then added and mixed gently by pipetting twice with a micro-pipettor. This final solution should consist of 5 µg of DNA in 250 µL of 0.25M $CaCl_2$. A second tube was then prepared containing 250 µL of 2×HBS (Hepes buffered solution). Using a 2 mL sterile pipette attached to a Pipet-Aid air was slowly bubbled through the 2×HBS solution. At the same time the DNA solution in the 0.25M $CaCl_2$ solution was added in a dropwise fashion. Bubbling was continued for approximately 5 seconds after addition of the final DNA droplet. The solution was then incubated at room temperature for up to 20 minutes before adding to 293A cells. 250 µL of the DNA/Calcium phosphate solution was added dropwise to a monolayer of 293A cells that had been seeded one day prior at $10^6$ cells per well of a 6 well plate. The cells were returned to the incubator and incubated overnight. The media was changed 24 h later. After 72 h the cells were split 1:6 into a 6 well plate. The monolayers were monitored daily by light microscopy for evidence of cytopathic effect (CPE). 7-10 days post transfection viral plaques were observed and the monolayer harvested by pipetting the media in the wells to lift the cells. The harvested cells and media were transferred to a 50 mL centrifuge tube followed by three rounds of freeze thawing (at −80° C. and 37° C.). The subsequent lysate, called the primary virus stock was clarified by centrifugation at full speed on a bench top centrifuge (4300× g) and a proportion of the lysate 10-50%) used to infect 293A cells in a T25 flask. The infected cells were incubated for 48 h before harvesting cells and media at complete CPE. The cells were once again harvested, freeze thawed and clarified before using this secondary viral stock to infect a T150 flask seeded at $1.5 \times 10^7$ cells per flask. Once complete CPE was achieved at 72 h the media and cells were harvested and treated as with earlier viral stocks to generate a tertiary stock.

Production in 293F Cells

ChAdV68 virus production was performed in 293F cells grown in 293 FreeStyle™ (ThermoFisher) media in an incubator at 8% $CO_2$. On the day of infection cells were diluted to $10^6$ cells per mL, with 98% viability and 400 mL were used per production run in 1 L Shake flasks (Corning). 4 mL of the tertiary viral stock with a target MOI of >3.3 was used per infection. The cells were incubated for 48-72 h until the viability was <70% as measured by Trypan blue. The infected cells were then harvested by centrifugation, full speed bench top centrifuge and washed in 1×PBS, re-centrifuged and then re-suspended in 20 mL of 10 mM Tris pH7.4. The cell pellet was lysed by freeze thawing 3× and clarified by centrifugation at 4,300×g for 5 minutes.

Purification by CsCl Centrifugation

Viral DNA was purified by CsCl centrifugation. Two discontinuous gradient runs were performed. The first to purify virus from cellular components and the second to further refine separation from cellular components and separate defective from infectious particles.

10 mL of 1.2 (26.8 g CsCl dissolved in 92 mL of 10 mM Tris pH 8.0) CsCl was added to polyallomer tubes. Then 8 mL of 1.4 CsCl (53 g CsCl dissolved in 87 mL of 10 mM Tris pH 8.0) was carefully added using a pipette delivering to the bottom of the tube. The clarified virus was carefully layered on top of the 1.2 layer. If needed more 10 mM Tris was added to balance the tubes. The tubes were then placed in a SW-32Ti rotor and centrifuged for 2 h 30 min at 10° C. The tube was then removed to a laminar flow cabinet and the virus band pulled using an 18 gauge needle and a 10 mL syringe. Care was taken not to remove contaminating host cell DNA and protein. The band was then diluted at least 2× with 10 mM Tris pH 8.0 and layered as before on a discontinuous gradient as described above. The run was performed as described before except that this time the run was performed overnight. The next day the band was pulled with care to avoid pulling any of the defective particle band. The virus was then dialyzed using a Slide-a-Lyzer™ Cassette (Pierce) against ARM buffer (20 mM Tris pH 8.0, 25 mM NaCl, 2.5% Glycerol). This was performed 3×, 1 h per buffer exchange. The virus was then aliquoted for storage at −80° C.

Viral Assays

VP concentration was performed by using an OD 260 assay based on the extinction coefficient of $1.1 \times 10^{12}$ viral particles (VP) is equivalent to an Absorbance value of 1 at OD260 nm. Two dilutions (1:5 and 1:10) of adenovirus were made in a viral lysis buffer (0.1% SDS, 10 mM Tris pH 7.4, 1 mM EDTA). OD was measured in duplicate at both dilutions and the VP concentration/mL was measured by multiplying the OD260 value X dilution factor X $1.1 \times 10^{12}$ VP.

An infectious unit (IU) titer was calculated by a limiting dilution assay of the viral stock. The virus was initially diluted 100× in DMEM/5% NS/1×PS and then subsequently diluted using 10-fold dilutions down to $1 \times 10^{-7}$. 100 µL of these dilutions were then added to 293A cells that were seeded at least an hour before at 3e5 cells/well of a 24 well plate. This was performed in duplicate. Plates were incubated for 48 h in a CO2 (5%) incubator at 37° C. The cells were then washed with 1×PBS and were then fixed with 100% cold methanol (−20° C.). The plates were then incubated at −20° C. for a minimum of 20 minutes. The wells were washed with 1×PBS then blocked in 1×PBS/0.1% BSA for 1 h at room temperature. A rabbit anti-Ad antibody (Abcam, Cambridge, MA) was added at 1:8,000 dilution in blocking buffer (0.25 ml per well) and incubated for 1 h at room temperature. The wells were washed 4× with 0.5 mL PBS per well. A HRP conjugated Goat anti-Rabbit antibody (Bethyl Labs, Montgomery Texas) diluted 1000× was added per well and incubated for 1 h prior to a final round of washing. 5 PBS washes were performed and the plates were developed using DAB (Diaminobenzidine tetrahydrochloride) substrate in Tris buffered saline (0.67 mg/mL DAB in 50 mM Tris pH 7.5, 150 mM NaCl) with 0.01% $H_2O_2$. Wells were developed for 5 min prior to counting. Cells were counted under a 10× objective using a dilution that gave between 4-40 stained cells per field of view. The field of view that was used was a 0.32 $mm^2$ grid of which there are equivalent to 625 per field of view on a 24 well plate. The number of infectious viruses/mL can be determined by the number of stained cells per grid multiplied by the number of grids per field of view multiplied by a dilution factor 10. Similarly, when working with GFP expressing cells florescent can be used rather than capsid staining to determine the number of GFP expressing virions per mL.

Immunizations

C57BL/6J female mice and Balb/c female mice were injected with 1×10⁸ viral particles (VP) of ChAdV68.5WTnt.MAG25mer in 100 uL volume, bilateral intramuscular injection (50 uL per leg).

Splenocyte Dissociation

Spleen and lymph nodes for each mouse were pooled in 3 mL of complete RPMI (RPMI, 10% FBS, penicillin/streptomycin). Mechanical dissociation was performed using the gentleMACS Dissociator (Miltenyi Biotec), following manufacturer's protocol. Dissociated cells were filtered through a 40 micron filter and red blood cells were lysed with ACK lysis buffer (150 mM $NH_4Cl$, 10 mM $KHCO_3$, 0.1 mM $Na_2EDTA$). Cells were filtered again through a 30 micron filter and then resuspended in complete RPMI. Cells were counted on the Attune NxT flow cytometer (Thermo Fisher) using propidium iodide staining to exclude dead and apoptotic cells. Cell were then adjusted to the appropriate concentration of live cells for subsequent analysis.

Ex Vivo Enzyme-Linked Immunospot (ELISPOT) Analysis

ELISPOT analysis was performed according to ELISPOT harmonization guidelines {DOI: 10.1038/nprot.2015.068} with the mouse IFNg ELISpotPLUS kit (MABTECH). 5×10⁴ splenocytes were incubated with 10 uM of the indicated peptides for 16 hours in 96-well IFNg antibody coated plates. Spots were developed using alkaline phosphatase. The reaction was timed for 10 minutes and was terminated by running plate under tap water. Spots were counted using an AID vSpot Reader Spectrum. For ELISPOT analysis, wells with saturation >50% were recorded as "too numerous to count". Samples with deviation of replicate wells >10% were excluded from analysis. Spot counts were then corrected for well confluency using the formula: spot count+2×(spot count×% confluence/[100%−% confluence]). Negative background was corrected by subtraction of spot counts in the negative peptide stimulation wells from the antigen stimulated wells. Finally, wells labeled too numerous to count were set to the highest observed corrected value, rounded up to the nearest hundred.

XV.B.2. Production of ChAdV68 Viral Delivery Particles after DNA Transfection

Figure 7C:
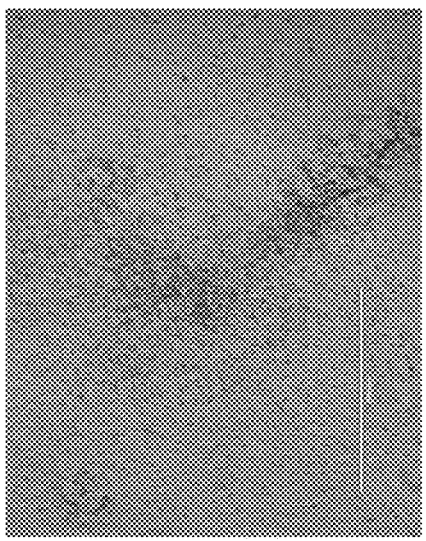
FIG. 7C illustrates ChAdV68.4WTnt.GFP virus production after transfection. HEK293A cells were transfected with ChAdV68.4WTnt.GFP DNA using the calcium phosphate protocol. Viral replication was observed 10 days after transfection and ChAdV68.4WTnt.GFP viral plaques were visualized using fluorescent microscopy at 100× magnification.
Figure 7B:
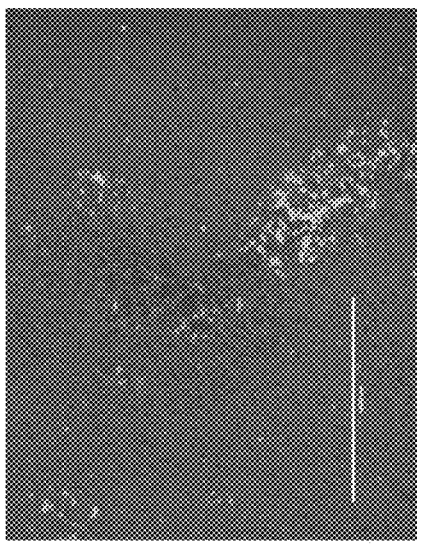
FIG. 7B illustrates ChAdV68.4WTnt.GFP virus production after transfection. HEK293A cells were transfected with ChAdV68.4WTnt.GFP DNA using the calcium phosphate protocol. Viral replication was observed 10 days after transfection and ChAdV68.4WTnt.GFP viral plaques were visualized using fluorescent microscopy at 40× magnification.
Figure 7A:
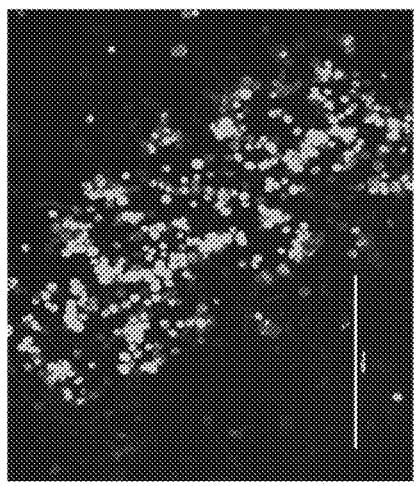
FIG. 7A illustrates ChAdV68.4WTnt.GFP virus production after transfection. HEK293A cells were transfected with ChAdV68.4WTnt.GFP DNA using the calcium phosphate protocol. Viral replication was observed 10 days after transfection and ChAdV68.4WTnt.GFP viral plaques were visualized using light microscopy (40× magnification).
Figure 8C:
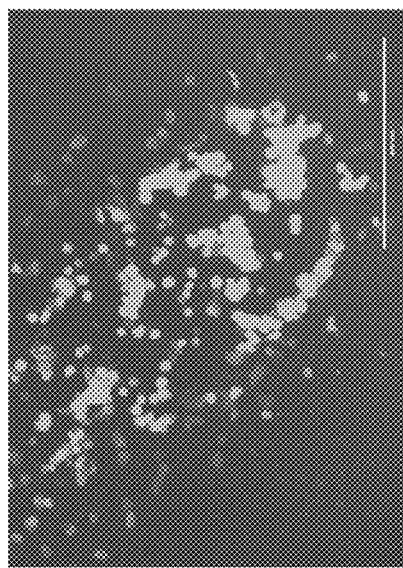
FIG. 8C illustrates ChAdV68.5WTnt.GFP virus production after transfection. HEK293A cells were transfected with ChAdV68.5WTnt.GFP DNA using the lipofectamine protocol. Viral replication (plaques) was observed 10 days after transfection. A lysate was made and used to reinfect a T25 flask of 293A cells. ChAdV68.5WTnt.GFP viral plaques were visualized and photographed 3 days later using fluorescent microscopy at 100× magnification.
Figure 8B:
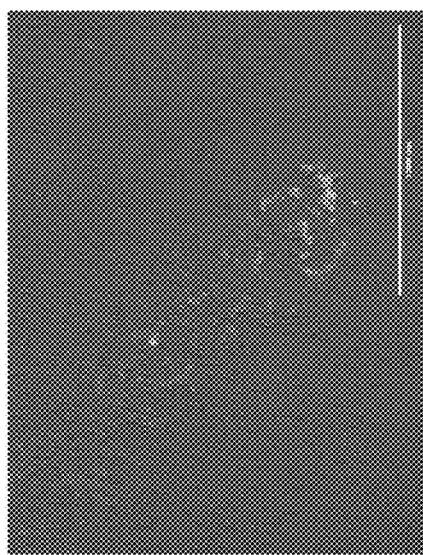
FIG. 8B illustrates ChAdV68.5WTnt.GFP virus production after transfection. HEK293A cells were transfected with ChAdV68.5WTnt.GFP DNA using the lipofectamine protocol. Viral replication (plaques) was observed 10 days after transfection. A lysate was made and used to reinfect a T25 flask of 293A cells. ChAdV68.5WTnt.GFP viral plaques were visualized and photographed 3 days later using fluorescent microscopy at 40× magnification.
Figure 8A:
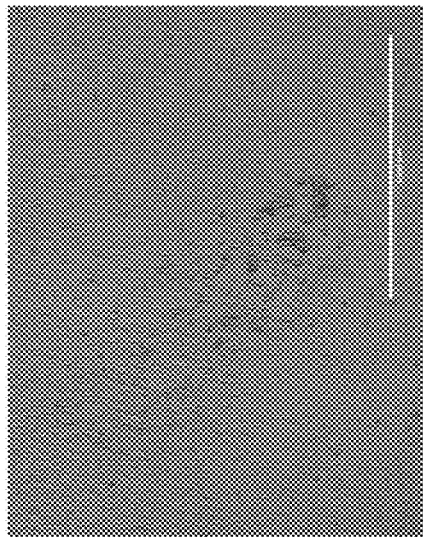
FIG. 8A illustrates ChAdV68.5WTnt.GFP virus production after transfection. HEK293A cells were transfected with ChAdV68.5WTnt.GFP DNA using the lipofectamine protocol. Viral replication (plaques) was observed 10 days after transfection. A lysate was made and used to reinfect a T25 flask of 293A cells. ChAdV68.5WTnt.GFP viral plaques were visualized and photographed 3 days later using light microscopy (40× magnification)

In one example, ChAdV68.4WTnt.GFP (FIG. 7) and ChAdV68.5WTnt.GFP (FIG. 8) DNA was transfected into HEK293A cells and virus replication (viral plaques) was observed 7-10 days after transfection. ChAdV68 viral plaques were visualized using light (FIGS. 7A and 8A) and fluorescent microscopy (FIG. 7B-C and FIG. 8B-C). GFP denotes productive ChAdV68 viral delivery particle production.

XV.B.3. ChAdV68 Viral Delivery Particles Expansion

Figure 9:
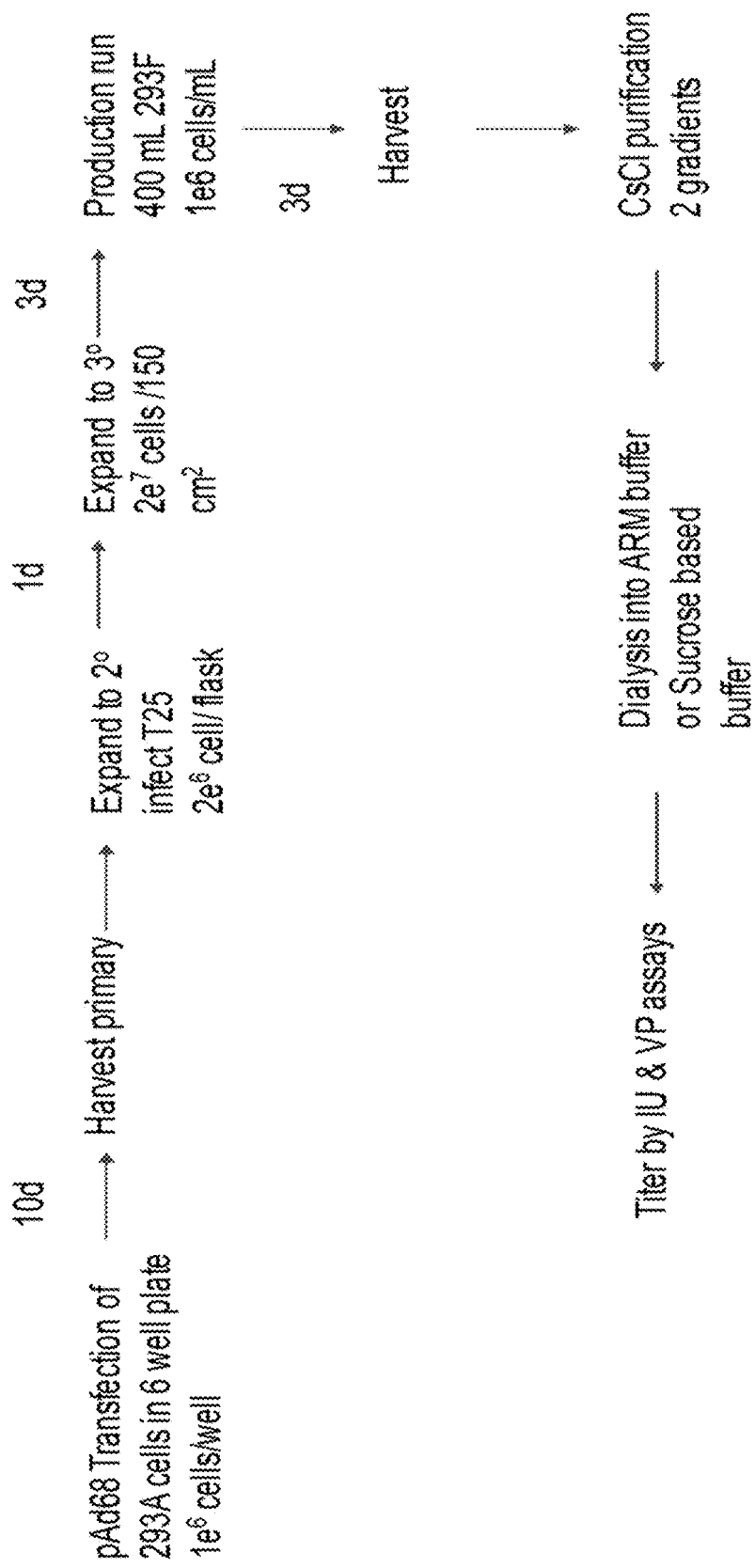
FIG. 9 illustrates the viral particle production scheme.

In one example, ChAdV68.4WTnt.GFP, ChAdV68.5WTnt.GFP, and ChAdV68.5WTnt.MAG25mer viruses were expanded in HEK293F cells and a purified virus stock produced 18 days after transfection (FIG. 9). Viral particles were quantified in the purified ChAdV68 virus stocks and compared to adenovirus type 5 (Ad5) and ChAdVY25 (a closely related ChAdV; Dicks, 2012, PloS ONE 7, e40385) viral stocks produced using the same protocol. ChAdV68 viral titers were comparable to Ad5 and ChAdVY25 (Table 7).

TABLE 7

Adenoviral vector production in 293F suspension cells

| Construct | Average VP/cell +/− SD |
|---|---|
| Ad5-Vectors (Multiple vectors) | 2.96e4 +/− 2.26e4 |
| Ad5-GFP | 3.89e4 |
| chAdY25-GFP | 1.75e3 +/− 6.03e1 |
| ChAdV68.4WTnt.GFP | 1.2e4 +/− 6.5e3 |
| ChAdV68.5WTnt.GFP | 1.8e3 |
| ChAdV68.5WTnt.MAG25mer | 1.39e3 +/− 1.1e3 |

*SD is only reported where multiple Production runs have been performed

XV.B.4. Evaluation of Immunogenicity in Tumor Models

Figure 15:
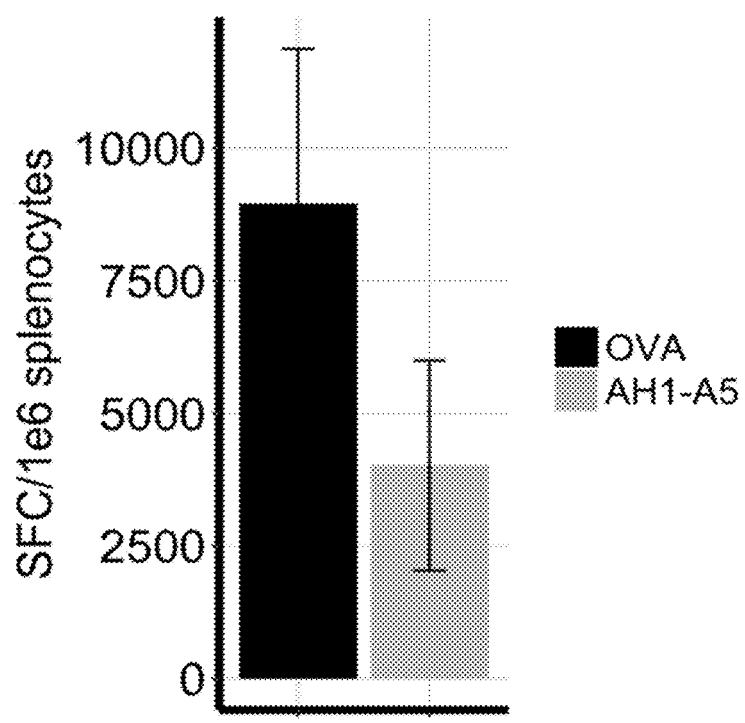
FIG. 15 illustrates ChAdV68 eliciting T-Cell responses to mouse tumor antigens in mice. Mice were immunized with ChAdV68.5WTnt.MAG25mer, and T-cell responses to the MHC class I epitope SIINFEKL (SEQ ID NO: 72) (OVA) were measured in C57BL/6J female mice and the MHC class I epitope AH1-A5 measured in Balb/c mice. Mean spot forming cells (SFCs) per $10^6$ splenocytes measured in ELISpot assays presented. Error bars represent standard deviation.

C68 vector expressing mouse tumor antigens were evaluated in mouse immunogenicity studies to demonstrate the C68 vector elicits T-cell responses. T-cell responses to the MHC class I epitope SIINFEKL (SEQ ID NO: 72) were measured in C57BL/6J female mice and the MHC class I epitope AH1-A5 (Slansky et al., 2000, Immunity 13:529-538) measured in Balb/c mice. As shown in FIG. 15, strong T-cell responses relative to control were measured after immunization of mice with ChAdV68.5WTnt.MAG25mer. Mean cellular immune responses of 8957 or 4019 spot forming cells (SFCs) per 10⁶ splenocytes were observed in ELISpot assays when C57BL/6J or Balb/c mice were immunized with ChAdV68.5WTnt.MAG25mer, respectively, 10 days after immunization.

Tumor infiltrating lymphocytes were also evaluated in CT26 tumor model evaluating ChAdV and co-administration of a an anti-CTLA4 antibody. Mice were implanted with CT26 tumors cells and 7 days after implantation, were immunized with ChAdV vaccine and treated with anti-CTLA4 antibody (clone 9D9) or IgG as a control. Tumor infiltrating lymphocytes were analyzed 12 days after immunization. Tumors from each mouse were dissociated using the gentleMACS Dissociator (Miltenyi Biotec) and mouse tumor dissociation kit (Miltenyi Biotec). Dissociated cells were filtered through a 30 micron filter and resuspended in complete RPMI. Cells were counted on the Attune NxT flow cytometer (Thermo Fisher) using propidium iodide staining to exclude dead and apoptotic cells. Cell were then adjusted to the appropriate concentration of live cells for subsequent analysis. Antigen specific cells were identified by MHC-tetramer complexes and co-stained with anti-CD8 and a viability marker. Tumors were harvested 12 days after prime immunization.

Figure 41:
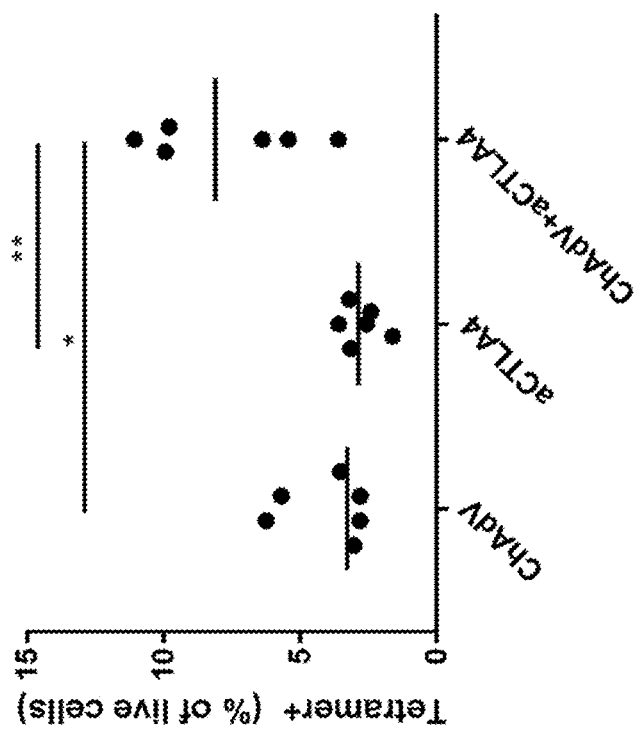
FIG. 41 shows frequency of CD8+ T cells recognizing the CT26 tumor antigen AH1 in CT26 tumor-bearing mice. P values determined using the one-way ANOVA with Tukey's multiple comparisons test; **P<0.001, *P<0.05. ChAdV=ChAdV68.5WTnt.MAG25mer; aCTLA4=anti-CTLA4 antibody, clone 9D9.

Antigen-specific CD8+ T cells within the tumor comprised a median of 3.3%, 2.2%, or 8.1% of the total live cell population in ChAdV, anti-CTLA4, and ChAdV+anti-CTLA4 treated groups, respectively (FIG. 41 and Table 40). Treatment with anti-CTLA in combination with active ChAdV immunization resulted in a statistically significant increase in the antigen-specific CD8+ T cell frequency over both ChAdV alone and anti-CTLA4 alone demonstrating anti-CTLA4, when co-administered with the ChAdV68 vaccine, increased the number of infiltrating T cells within a tumor.

TABLE 40

Tetramer+ infiltrating CD8 T cell frequencies in CT26 tumors

| Treatment | Median % tetramer+ |
|---|---|
| ChAdV68.5WTnt.MAG25mer (ChAdV) | 3.3 |
| Anti-CTLA4 | 2.2 |
| ChAdV68.5WTnt.MAG25mer (ChAdV) + anti-CTLA4 | 8.1 |

XVI. Alphavirus Antigen Cassette Delivery Vector

XVI.A. Alphavirus Delivery Vector Evaluation Materials and Methods

In Vitro Transcription to Generate RNA

For in vitro testing: plasmid DNA was linearized by restriction digest with PmeI, column purified following manufacturer's protocol (GeneJet DNA cleanup kit, Thermo) and used as template. In vitro transcription was performed using the RiboMAX Large Scale RNA production System (Promega) with the $m^7G$ cap analog (Promega) according to manufacturer's protocol. mRNA was purified using the RNeasy kit (Qiagen) according to manufacturer's protocol.

For in vivo studies: RNA was generated and purified by TriLink Biotechnologies and capped with Enzymatic Cap1.

Transfection of RNA

HEK293A cells were seeded at 6e4 cells/well for 96 wells and 2e5 cells/well for 24 wells, ~16 hours prior to transfection. Cells were transfected with mRNA using MessengerMAX lipofectamine (Invitrogen) and following manufacturer's protocol. For 96-wells, 0.15 uL of lipofectamine and 10 ng of mRNA was used per well, and for 24-wells, 0.75 uL of lipofectamine and 150 ng of mRNA was used per well. A GFP expressing mRNA (TriLink Biotechnologies) was used as a transfection control.

Luciferase Assay

Luciferase reporter assay was performed in white-walled 96-well plates with each condition in triplicate using the ONE-Glo luciferase assay (Promega) following manufacturer's protocol. Luminescence was measured using the SpectraMax.

qRT-PCR

Transfected cells were rinsed and replaced with fresh media 2 hours post transfection to remove any untransfected mRNA. Cells were then harvested at various timepoints in RLT plus lysis buffer (Qiagen), homogenized using a QiaShredder (Qiagen) and RNA was extracted using the RNeasy kit (Qiagen), all according to manufacturer's protocol. Total RNA was quantified using a Nanodrop (Thermo Scientific). qRT-PCR was performed using the Quantitect Probe One-Step RT-PCR kit (Qiagen) on the qTower³ (Analytik Jena) according to manufacturer's protocol, using 20 ng of total RNA per reaction. Each sample was run in triplicate for each probe. Actin or GusB were used as reference genes. Custom primer/probes were generated by IDT (Table 8).

TABLE 8 qPCR primers/probes

| Target | | | | SEQ ID NO: |
|---|---|---|---|---|
| Luci | Primer1 | | GTGGTGTGCAGCGAGAATAG | 178 |
| | Primer2 | | CGCTCGTTGTAGATGTCGTTAG | 179 |
| | Probe | | /56-FAM/TTGCAGTTC/ZEN/ TTCATGCCCGTGTTG/ 3IABkFQ/ | 180 |
| GusB | Primer1 | | GTTTTTGATCCAGACCCAGATG | 181 |
| | Primer2 | | GCCCATTATTCAGAGCGAGTA | 182 |
| | Probe | | /56-FAM/TGCAGGGTT/ZEN/ TCACCAGGATCCAC/3IABkFQ/ | 183 |
| ActB | Primer1 | | CCTTGCACATGCCGGAG | 184 |
| | Primer2 | | ACAGAGCCTCGCCTTTG | 185 |
| | Probe | | /56-FAM/TCATCCATG/ZEN/ GTGAGCTGGCGG/3IABkFQ/ | 186 |
| MAG-25mer Set1 | Primer1 | | CTGAAAGCTCGGTTTGCTAATG | 187 |
| | Primer2 | | CCATGCTGGAAGAGACAATCT | 188 |
| | Probe | | /56-FAM/CGTTTCTGA/ZEN/ TGGCGCTGACCGATA/ 3IABkFQ/ | 189 |
| MAG-25mer Set2 | Primer1 | | TATGCCTATCCTGTCTCCTCTG | 190 |
| | Primer2 | | GCTAATGCAGCTAAGTCCTCTC | 191 |
| | Probe | | /56-FAM/TGTTTACCC/ZEN/ TGACCGTGCCTTCTG/ 3IABkFQ/ | 192 |

B16-OVA Tumor Model

C57BL/6J mice were injected in the lower left abdominal flank with $10^5$ B16-OVA cells/animal. Tumors were allowed to grow for 3 days prior to immunization.

CT26 Tumor Model

Balb/c mice were injected in the lower left abdominal flank with $10^6$ CT26 cells/animal. Tumors were allowed to grow for 7 days prior to immunization.

Immunizations

For srRNA vaccine, mice were injected with 10 ug of RNA in 100 uL volume, bilateral intramuscular injection (50 uL per leg). For Ad5 vaccine, mice were injected with $5 \times 10^{10}$ viral particles (VP) in 100 uL volume, bilateral intramuscular injection (50 uL per leg). Animals were injected with anti-CTLA-4 (clone 9D9, BioXcell), anti-PD-1 (clone RMP1-14, BioXcell) or anti-IgG (clone MPC-11, BioXcell), 250 ug dose, 2 times per week, via intraperitoneal injection.

In Vivo Bioluminescent Imaging

At each timepoint mice were injected with 150 mg/kg luciferin substrate via intraperitoneal injection and bioluminescence was measured using the IVIS In vivo imaging system (PerkinElmer) 10-15 minutes after injection.

Splenocyte Dissociation

Spleen and lymph nodes for each mouse were pooled in 3 mL of complete RPMI (RPMI, 10% FBS, penicillin/streptomycin). Mechanical dissociation was performed using the gentleMACS Dissociator (Miltenyi Biotec), following manufacturer's protocol. Dissociated cells were filtered through a 40 micron filter and red blood cells were lysed with ACK lysis buffer (150 mM $NH_4Cl$, 10 mM $KHCO_3$, 0.1 mM $Na_2EDTA$). Cells were filtered again through a 30 micron filter and then resuspended in complete RPMI. Cells were counted on the Attune NxT flow cytometer (Thermo Fisher) using propidium iodide staining to exclude dead and apoptotic cells. Cell were then adjusted to the appropriate concentration of live cells for subsequent analysis.

Ex Vivo Enzyme-Linked Immunospot (ELISPOT) Analysis

ELISPOT analysis was performed according to ELISPOT harmonization guidelines {DOI: 10.1038/nprot.2015.068} with the mouse IFNg ELISpotPLUS kit (MABTECH). $5 \times 10^4$ splenocytes were incubated with 10 uM of the indicated peptides for 16 hours in 96-well IFNg antibody coated plates. Spots were developed using alkaline phosphatase. The reaction was timed for 10 minutes and was terminated by running plate under tap water. Spots were counted using an AID vSpot Reader Spectrum. For ELISPOT analysis, wells with saturation >50% were recorded as "too numerous to count". Samples with deviation of replicate wells >10% were excluded from analysis. Spot counts were then corrected for well confluency using the formula: spot count+ 2×(spot count×% confluence/[100%−% confluence]). Negative background was corrected by subtraction of spot counts in the negative peptide stimulation wells from the antigen stimulated wells. Finally, wells labeled too numerous to count were set to the highest observed corrected value, rounded up to the nearest hundred.

XVI.B. Alphavirus Vector

XVI.B.1. Alphavirus Vector In Vitro Evaluation

Figure 10:
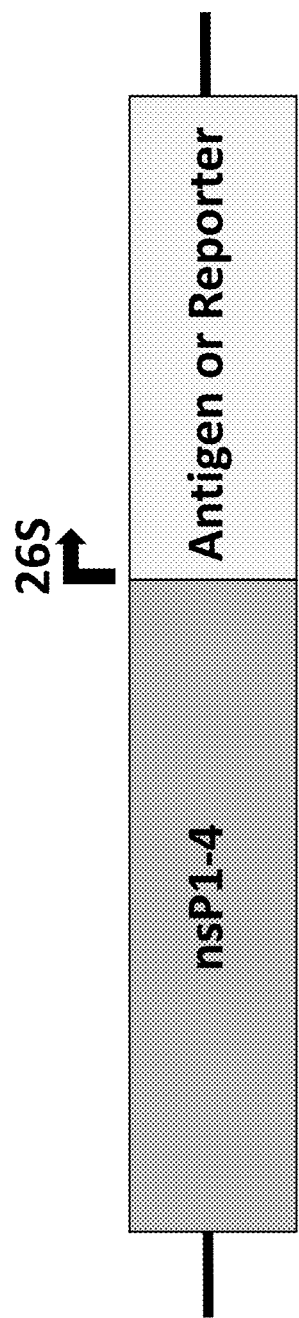
FIG. 10 illustrates the alphavirus derived VEE self-replicating RNA (srRNA) vector.

In one implementation of the present invention, a RNA alphavirus backbone for the antigen expression system was generated from a Venezuelan Equine Encephalitis (VEE) (Kinney, 1986, Virology 152: 400-413) based self-replicating RNA (srRNA) vector. In one example, the sequences encoding the structural proteins of VEE located 3' of the 26S subgenomic promoter were deleted (VEE sequences 7544 to 11,175 deleted; numbering based on Kinney et al 1986; SEQ ID NO:6) and replaced by antigen sequences (SEQ ID NO:14 and SEQ ID NO:4) or a luciferase reporter (e.g., VEE-Luciferase, SEQ ID NO:15) (FIG. 10). RNA was transcribed from the srRNA DNA vector in vitro, transfected into HEK293A cells and luciferase reporter expression was measured. In addition, an (non-replicating) mRNA encoding luciferase was transfected for comparison. An ~30,000-fold increase in srRNA reporter signal was observed for VEE-Luciferase srRNA when comparing the 23 hour measurement vs the 2 hour measurement (Table 9). In contrast, the mRNA reporter exhibited a less than 10-fold increase in signal over the same time period (Table 9).

TABLE 9

Expression of luciferase from VEE self-replicating vector increases over time. HEK293A cells transfected with 10 ng of VEE-Luciferase srRNA or 10 ng of non-replicating luciferase mRNA (TriLink L-6307) per well in 96 wells. Luminescence was measured at various times post transfection. Luciferase expression is reported as relative luminescence units (RLU). Each data point is the mean +/− SD of 3 transfected wells.

| Construct | Timepoint (hr) | Mean RLU | Standard Dev triplicate wells) |
|---|---|---|---|
| mRNA | 2 | 878.6666667 | 120.7904522 |
| mRNA | 5 | 1847.333333 | 978.515372 |
| mRNA | 9 | 4847 | 868.3271273 |
| mRNA | 23 | 8639.333333 | 751.6816702 |
| SRRNA | 2 | 27 | 15 |
| SRRNA | 5 | 4884.333333 | 2955.158935 |
| SRRNA | 9 | 182065.5 | 16030.81784 |
| SRRNA | 23 | 783658.3333 | 68985.05538 |

In another example, replication of the srRNA was confirmed directly by measuring RNA levels after transfection of either the luciferase encoding srRNA (VEE-Luciferase) or an srRNA encoding a multi-epitope cassette (VEE-MAG25mer) using quantitative reverse transcription polymerase chain reaction (qRT-PCR). An ~150-fold increase in RNA was observed for the VEE-luciferase srRNA (Table 10), while a 30-50-fold increase in RNA was observed for the VEE-MAG25mer srRNA (Table 11). These data confirm that the VEE srRNA vectors replicate when transfected into cells.

TABLE 10

Direct measurement of RNA replication in VEE-Luciferase srRNA transfected cells. HEK293A cells transfected with VEE-Luciferase srRNA (150 ng per well, 24-well) and RNA levels quantified by qRT-PCR at various times after transfection. Each measurement was normalized based on the Actin reference gene and fold-change relative to the 2 hour timepoint is presented.

| Timepoint (hr) | Luciferase Ct | Actin Ct | dCt | Ref dCt | ddCt | Relative Fold change |
|---|---|---|---|---|---|---|
| 2 | 20.51 | 18.14 | 2.38 | 2.38 | 0.00 | 1.00 |
| 4 | 20.09 | 18.39 | 1.70 | 2.38 | −0.67 | 1.59 |
| 6 | 15.50 | 18.19 | −2.69 | 2.38 | −5.07 | 33.51 |
| 8 | 13.51 | 18.36 | −4.85 | 2.38 | −7.22 | 149.43 |

TABLE 11

Direct measurement of RNA replication in VEE-MAG25mer srRNA transfected cells. HEK293 cells transfected with VEE-MAG25mer srRNA (150 ng per well, 24-well) and RNA levels quantified by qRT-PCR at various times after transfection. Each measurement was normalized based on the GusB reference gene and fold-change relative to the 2 hour timepoint is presented. Different lines on the graph represent 2 different qPCR primer/probe sets, both of which detect the enitone cassette region of the srRNA.

| Primer/probe | Timepoint (hr) | GusB Ct | Ct | dCt | Ref dCt | ddCt | Relative Fold-Change |
|---|---|---|---|---|---|---|---|
| Set1 | 2 | 18.96 | 22.41 | −3.45 | −3.45 | 0.00 | 1.00 |
| Set1 | 4 | 17.46 | 22.27 | −4.81 | −3.45 | −1.37 | 2.58 |
| Set1 | 6 | 14.87 | 22.04 | −7.17 | −3.45 | −3.72 | 13.21 |
| Set1 | 8 | 14.16 | 22.19 | −8.02 | −3.45 | −4.58 | 23.86 |
| Set1 | 24 | 13.16 | 22.01 | −8.86 | −3.45 | −5.41 | 42.52 |
| Set1 | 36 | 13.53 | 22.63 | −9.10 | −3.45 | −5.66 | 50.45 |
| Set2 | 2 | 17.75 | 22.41 | −4.66 | −4.66 | 0.00 | 1.00 |
| Set2 | 4 | 16.66 | 22.27 | −5.61 | −4.66 | −0.94 | 1.92 |
| Set2 | 6 | 14.22 | 22.04 | −7.82 | −4.66 | −3.15 | 8.90 |
| Set2 | 8 | 13.18 | 22.19 | −9.01 | −4.66 | −4.35 | 20.35 |
| Set2 | 24 | 12.22 | 22.01 | −9.80 | −4.66 | −5.13 | 35.10 |
| Set2 | 36 | 13.08 | 22.63 | −9.55 | −4.66 | −4.89 | 29.58 |

XVI.B.2. Alphavirus Vector in vivo Evaluation

Figure 11:
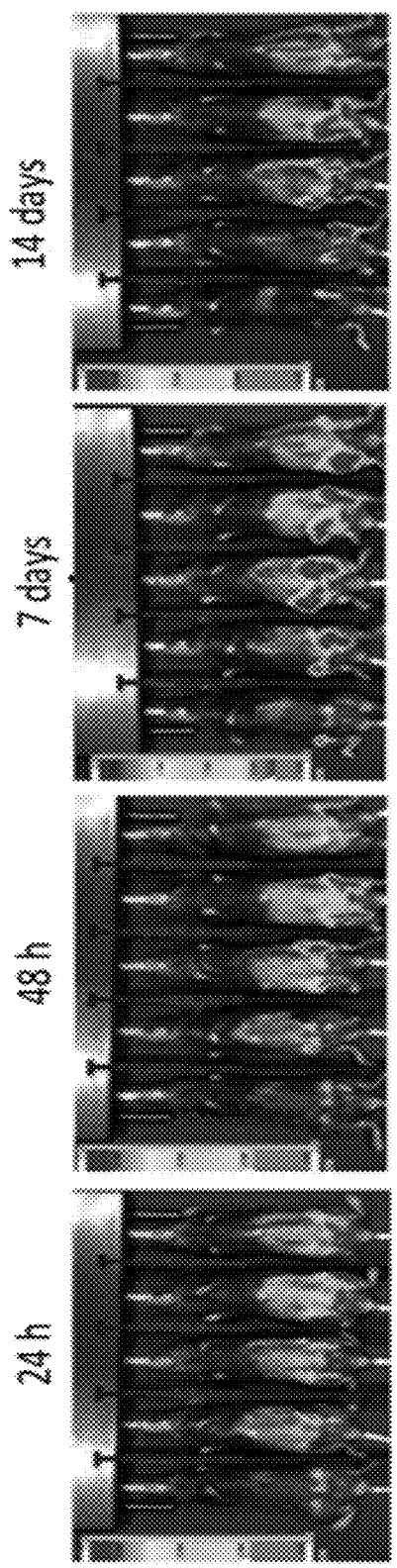
FIG. 11 illustrates in vivo reporter expression after inoculation of C57BL/6J mice with VEE-Luciferase srRNA. Shown are representative images of luciferase signal following immunization of C57BL/6J mice with VEE-Luciferase srRNA (10 ug per mouse, bilateral intramuscular injection, MC3 encapsulated) at various timepoints.

In another example, VEE-Luciferase reporter expression was evaluated in vivo. Mice were injected with 10 ug of VEE-Luciferase srRNA encapsulated in lipid nanoparticle (MC3) and imaged at 24 and 48 hours, and 7 and 14 days post injection to determine bioluminescent signal. Luciferase signal was detected at 24 hours post injection and increased over time and appeared to peak at 7 days after srRNA injection (FIG. 11).

XVI.B.3. Alphavirus Vector Tumor Model Evaluation

In one implementation, to determine if the VEE srRNA vector directs antigen-specific immune responses in vivo, a VEE srRNA vector was generated (VEE-UbAAY, SEQ ID NO:14) that expresses 2 different MHC class I mouse tumor epitopes, SIINFEKL (SEQ ID NO: 72) and AH1-A5 (Slansky et al., 2000, Immunity 13:529-538). The SFL (SIINFEKL (SEQ ID NO: 72)) epitope is expressed by the B16-OVA melanoma cell line, and the AH1-A5 (SPSYAYHQF (SEQ ID NO: 73); Slansky et al., 2000, Immunity) epitope induces T cells targeting a related epitope (AH1/SPSYVYHQF (SEQ ID NO: 193); Huang et al., 1996, Proc Natl Acad Sci USA 93:9730-9735) that is expressed by the CT26 colon carcinoma cell line. In one example, for in vivo studies, VEE-UbAAY srRNA was generated by in vitro transcription using T7 polymerase (TriLink Biotechnologies) and encapsulated in a lipid nanoparticle (MC3).

A strong antigen-specific T-cell response targeting SFL, relative to control, was observed two weeks after immunization of B16-OVA tumor bearing mice with MC3 formulated VEE-UbAAY srRNA. In one example, a median of 3835 spot forming cells (SFC) per $10^6$ splenocytes was measured after stimulation with the SFL peptide in ELISpot assays (FIG. 12A, Table 12) and 1.8% (median) of CD8 T-cells were SFL antigen-specific as measured by pentamer staining (FIG. 12B, Table 12). In another example, co-administration of an anti-CTLA-4 monoclonal antibody (mAb) with the VEE srRNA vaccine resulted in a moderate increase in overall T-cell responses with a median of 4794.5 SFCs per $10^6$ splenocytes measured in the ELISpot assay (FIG. 12A, Table 12).

TABLE 12

Results of ELISPOT and MHCI-pentamer staining assays 14 days post VEE srRNA immunization in B16-OVA tumor bearing C57BL/6J mice.

| Group | Mouse | SFC/1e6 splenocytes | Pentamer positive (% of CD8) | Group | Mouse | SFC/1e6 splenocytes | Pentamer positive (% of CD8) |
|---|---|---|---|---|---|---|---|
| Control | 1 | 47 | 0.22 | Vax | 1 | 6774 | 4.92 |
| | 2 | 80 | 0.32 | | 2 | 2323 | 1.34 |
| | 3 | 0 | 0.27 | | 3 | 2997 | 1.52 |
| | 4 | 0 | 0.29 | | 4 | 4492 | 1.86 |
| | 5 | 0 | 0.27 | | 5 | 4970 | 3.7 |
| | 6 | 0 | 0.25 | | 6 | | 4.13 |
| | 7 | 0 | 0.23 | | 7 | 3835 | 1.66 |
| | 8 | 87 | 0.25 | | 8 | 3119 | 1.64 |
| aCTLA4 | 1 | 0 | 0.24 | Vax + | 1 | 6232 | 2.16 |
| | 2 | 0 | 0.26 | aCTLA4 | 2 | 4242 | 0.82 |
| | 3 | 0 | 0.39 | | 3 | 5347 | 1.57 |
| | 4 | 0 | 0.28 | | 4 | 6568 | 2.33 |
| | 5 | 0 | 0.28 | | 5 | 6269 | 1.55 |
| | 6 | 0 | 0.28 | | 6 | 4056 | 1.74 |
| | 7 | 0 | 0.31 | | 7 | 4163 | 1.14 |
| | 8 | 6 | 0.26 | | 8 | 3667 | 1.01 |

* Note that results from mouse #6 in the Vax group were excluded from analysis due to high variability between triplicate wells.

Figure 13A:
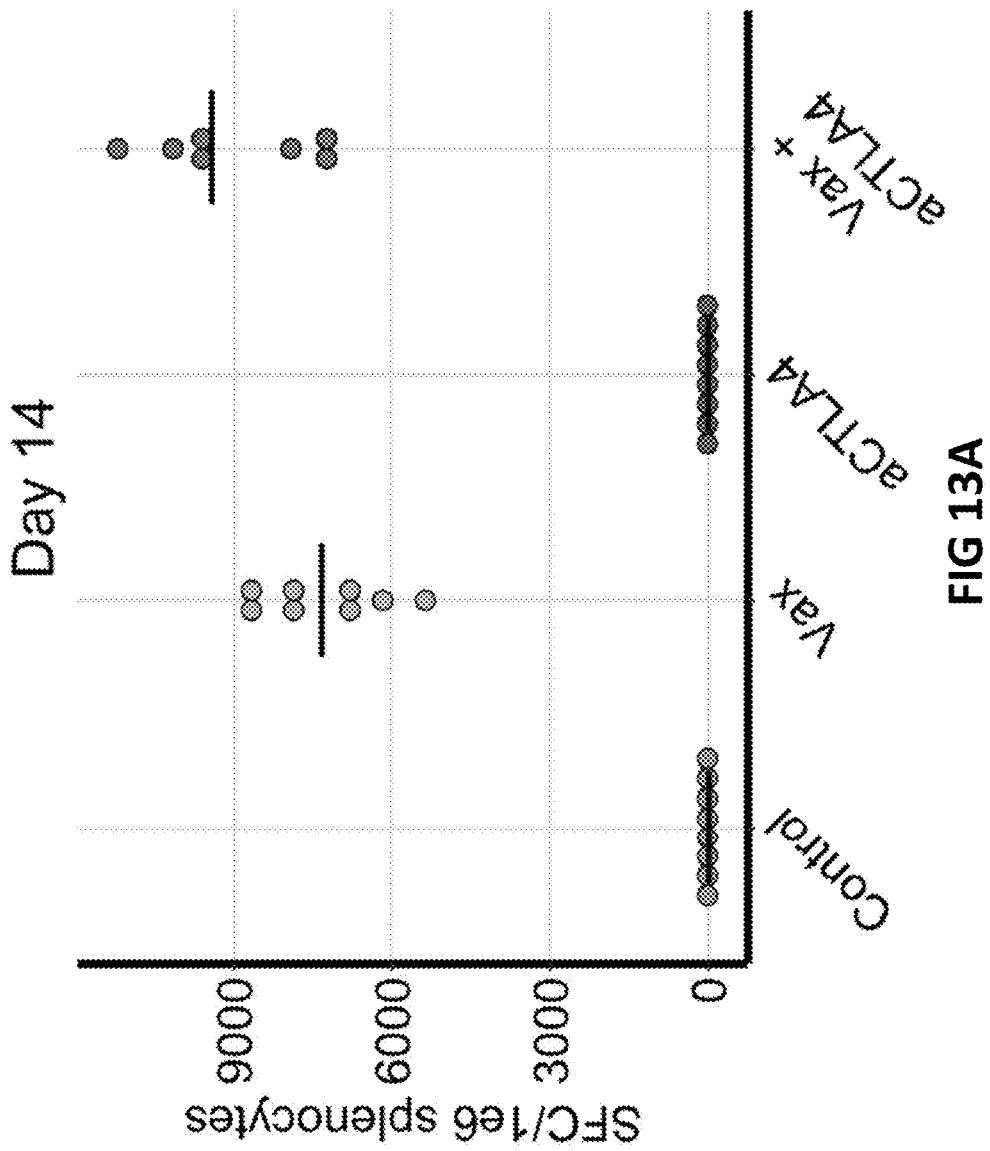
FIG. 13A illustrates antigen-specific T-cell responses following heterologous prime/boost in B16-OVA tumor bearing mice. B16-OVA tumor bearing C57BL/6J mice were injected with adenovirus expressing GFP (Ad5-GFP) and boosted with VEE-Luciferase srRNA formulated with MC3 LNP (Control) or Ad5-UbAAY and boosted with VEE-UbAAY srRNA (Vax). Both the Control and Vax groups were also treated with an IgG control mAb. A third group was treated with the Ad5-GFP prime/VEE-Luciferase srRNA boost in combination with anti-CTLA-4 (aCTLA-4), while the fourth group was treated with the Ad5-UbAAY prime/VEE-UbAAY boost in combination with anti-CTLA-4 (Vax+aCTLA-4). In addition, all mice were treated with anti-PD-1 mAb starting at day 21. T-cell responses were measured by IFN-gamma ELISPOT. Mice were sacrificed and spleens and lymph nodes collected at 14 days post immunization with adenovirus.
Figure 13B:
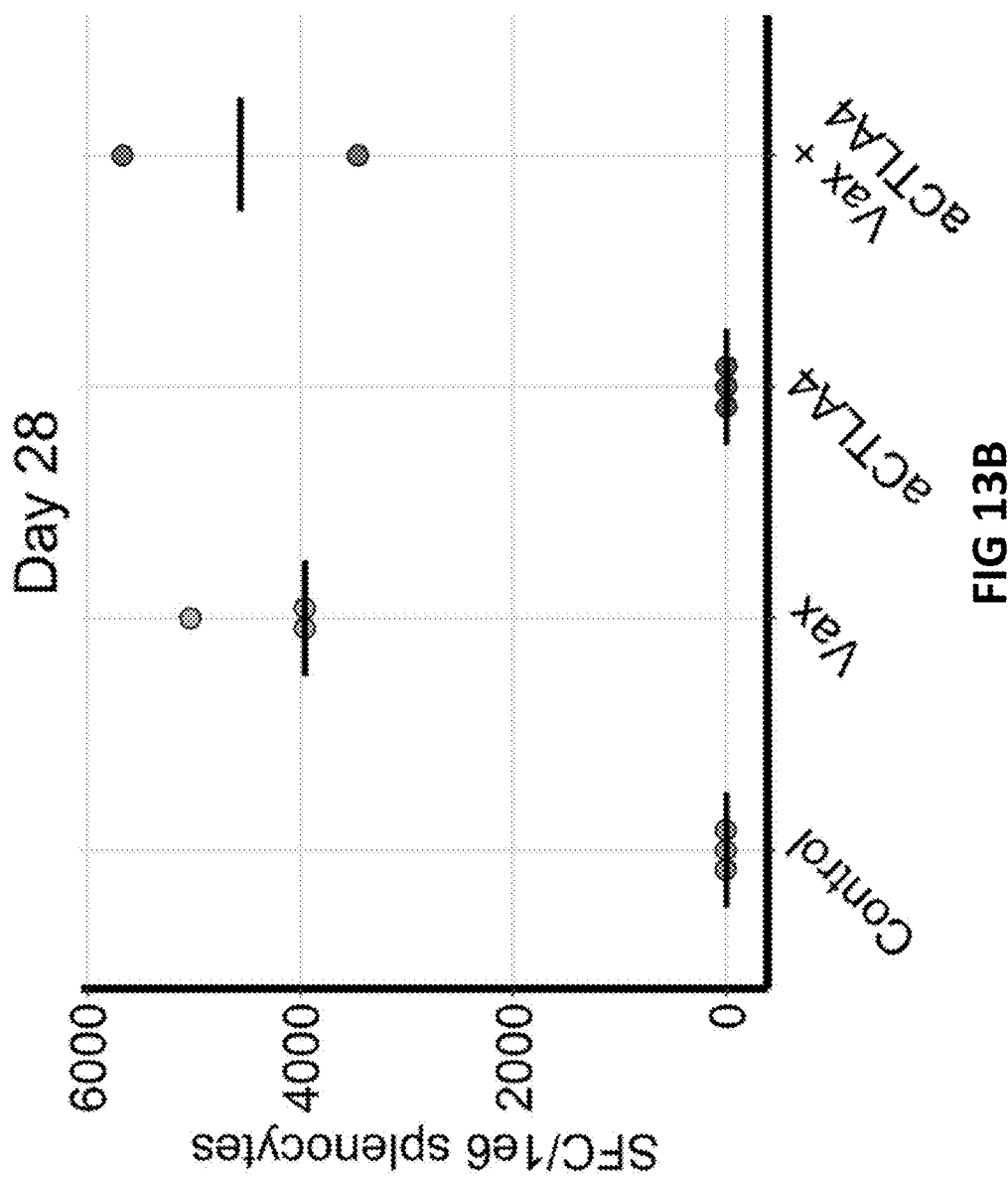
FIG. 13B illustrates antigen-specific T-cell responses following heterologous prime/boost in B16-OVA tumor bearing mice. B16-OVA tumor bearing C57BL/6J mice were injected with adenovirus expressing GFP (Ad5-GFP) and boosted with VEE-Luciferase srRNA formulated with MC3 LNP (Control) or Ad5-UbAAY and boosted with VEE-UbAAY srRNA (Vax). Both the Control and Vax groups were also treated with an IgG control mAb. A third group was treated with the Ad5-GFP prime/VEE-Luciferase srRNA boost in combination with anti-CTLA-4 (aCTLA-4), while the fourth group was treated with the Ad5-UbAAY prime/VEE-UbAAY boost in combination with anti-CTLA-4 (Vax+aCTLA-4). In addition, all mice were treated with anti-PD-1 mAb starting at day 21. T-cell responses were measured by IFN-gamma ELISPOT. Mice were sacrificed and spleens and lymph nodes collected at 14 days post immunization with adenovirus and 14 days post boost with srRNA (day 28 after prime).
Figure 13C:
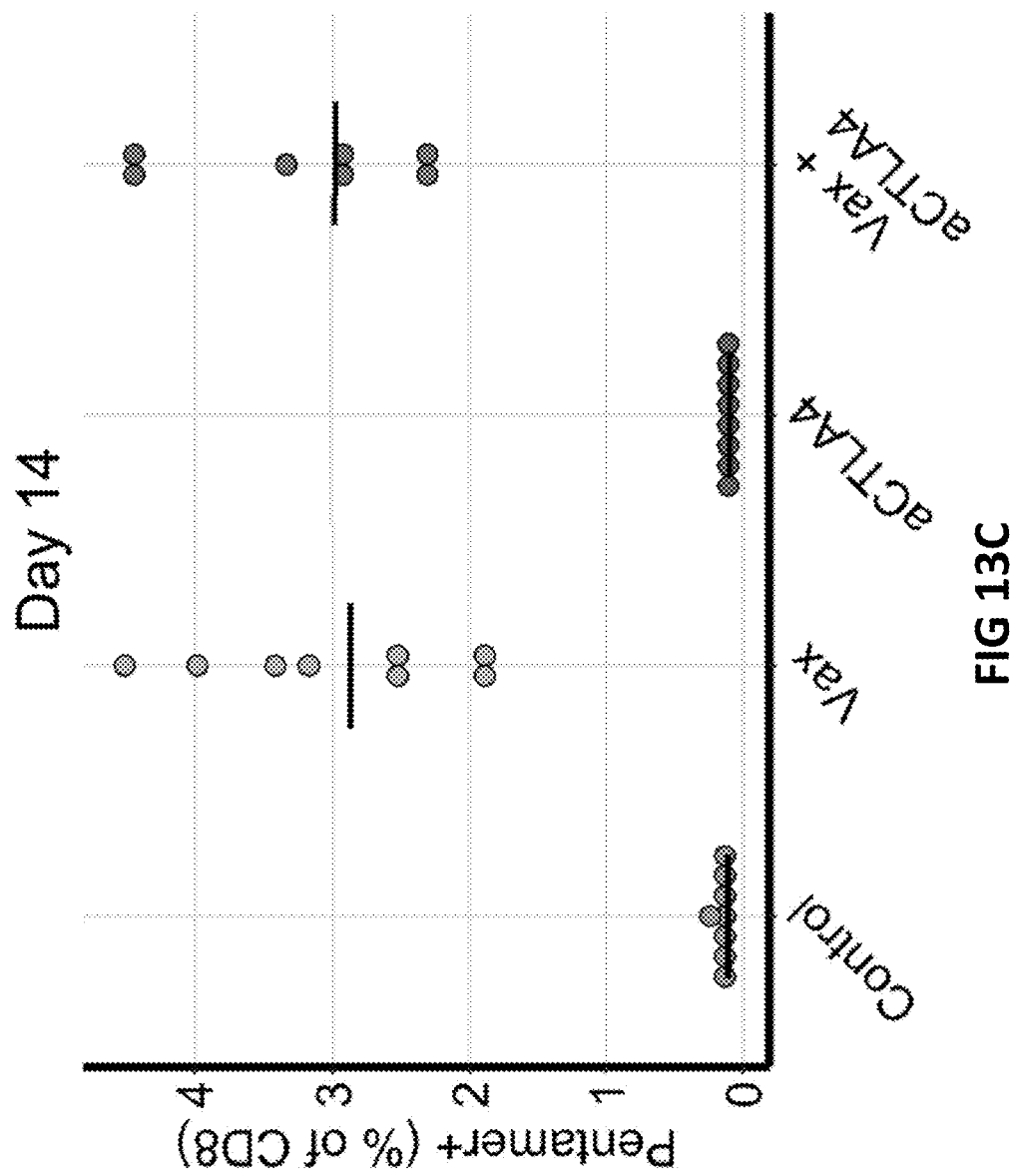
FIG. 13C illustrates antigen-specific T-cell responses following heterologous prime/boost in B16-OVA tumor bearing mice. B16-OVA tumor bearing C57BL/6J mice were injected with adenovirus expressing GFP (Ad5-GFP) and boosted with VEE-Luciferase srRNA formulated with MC3 LNP (Control) or Ad5-UbAAY and boosted with VEE-UbAAY srRNA (Vax). Both the Control and Vax groups were also treated with an IgG control mAb. A third group was treated with the Ad5-GFP prime/VEE-Luciferase srRNA boost in combination with anti-CTLA-4 (aCTLA-4), while the fourth group was treated with the Ad5-UbAAY prime/VEE-UbAAY boost in combination with anti-CTLA-4 (Vax+aCTLA-4). In addition, all mice were treated with anti-PD-1 mAb starting at day 21. T-cell responses were measured by MHC class I pentamer staining. Mice were sacrificed and spleens and lymph nodes collected at 14 days post immunization with adenovirus.
Figure 13D:
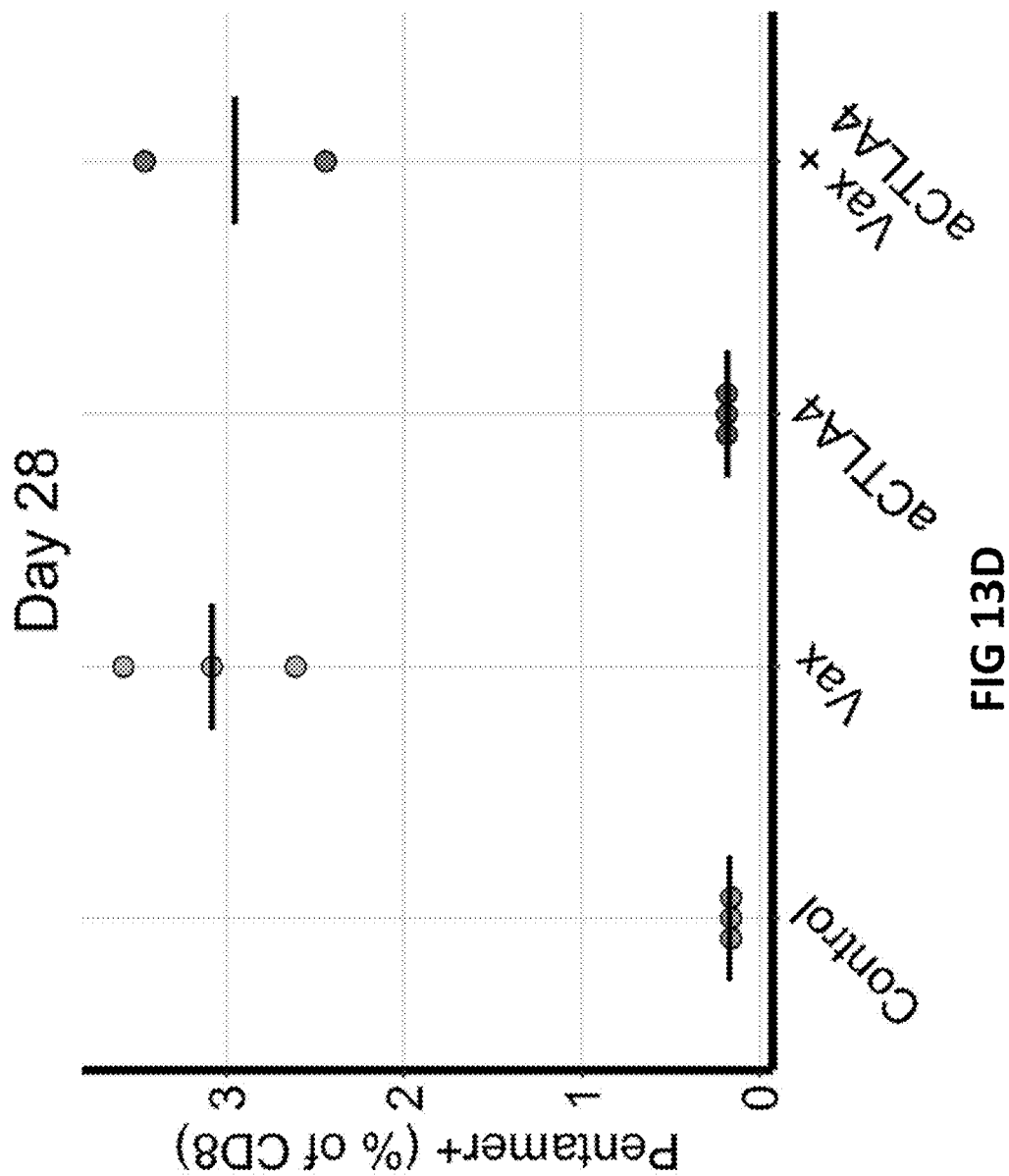
FIG. 13D illustrates antigen-specific T-cell responses following heterologous prime/boost in B16-OVA tumor bearing mice. B16-OVA tumor bearing C57BL/6J mice were injected with adenovirus expressing GFP (Ad5-GFP) and boosted with VEE-Luciferase srRNA formulated with MC3 LNP (Control) or Ad5-UbAAY and boosted with VEE-UbAAY srRNA (Vax). Both the Control and Vax groups were also treated with an IgG control mAb. A third group was treated with the Ad5-GFP prime/VEE-Luciferase srRNA boost in combination with anti-CTLA-4 (aCTLA-4), while the fourth group was treated with the Ad5-UbAAY prime/VEE-UbAAY boost in combination with anti-CTLA-4 (Vax+aCTLA-4). In addition, all mice were treated with anti-PD-1 mAb starting at day 21. T-cell responses were measured by MHC class I pentamer staining. Mice were sacrificed and spleens and lymph nodes collected at 14 days post immunization with adenovirus and 14 days post boost with srRNA (day 28 after prime).

In another implementation, to mirror a clinical approach, a heterologous prime/boost in the B16-OVA and CT26 mouse tumor models was performed, where tumor bearing mice were immunized first with adenoviral vector expressing the same antigen cassette (Ad5-UbAAY), followed by a boost immunization with the VEE-UbAAY srRNA vaccine 14 days after the Ad5-UbAAY prime. In one example, an antigen-specific immune response was induced by the Ad5-UbAAY vaccine resulting in 7330 (median) SFCs per $10^6$ splenocytes measured in the ELISpot assay (FIG. 13A, Table 13) and 2.9% (median) of CD8 T-cells targeting the SFL antigen as measured by pentamer staining (FIG. 13C, Table 13). In another example, the T-cell response was maintained 2 weeks after the VEE-UbAAY srRNA boost in the B16-OVA model with 3960 (median) SFL-specific SFCs per $10^6$ splenocytes measured in the ELISpot assay (FIG. 13B, Table 13) and 3.1% (median) of CD8 T-cells targeting the SFL antigen as measured by pentamer staining (FIG. 13D, Table 13).

TABLE 13

Immune monitoring of B16-OVA mice following heterologous prime/boost with Ad5 vaccine prime and srRNA boost.

| Group | Mouse | SFC/1e6 splenocytes | Pentamer positive (% of CD8) | Group | Mouse | SFC/1e6 splenocytes | Pentamer positive (% of CD8) |
|---|---|---|---|---|---|---|---|
| Day 14 | | | | | | | |
| Control | 1 | 0 | 0.10 | Vax | 1 | 8514 | 1.87 |
| | 2 | 0 | 0.09 | | 2 | 7779 | 1.91 |
| | 3 | 0 | 0.11 | | 3 | 6177 | 3.17 |
| | 4 | 46 | 0.18 | | 4 | 7945 | 3.41 |
| | 5 | 0 | 0.11 | | 5 | 8821 | 4.51 |
| | 6 | 16 | 0.11 | | 6 | 6881 | 2.48 |
| | 7 | 0 | 0.24 | | 7 | 5365 | 2.57 |
| | 8 | 37 | 0.10 | | 8 | 6705 | 3.98 |

TABLE 13-continued

Immune monitoring of B16-OVA mice following heterologous prime/boost with Ad5 vaccine prime and srRNA boost.

| Group | Mouse | SFC/1e6 splenocytes | Pentamer positive (% of CD8) | Group | Mouse | SFC/1e6 splenocytes | Pentamer positive (% of CD8) |
|---|---|---|---|---|---|---|---|
| aCTLA4 | 1 | 0 | 0.08 | Vax + | 1 | 9416 | 2.35 |
|  | 2 | 29 | 0.10 | aCTLA4 | 2 | 7918 | 3.33 |
|  | 3 | 0 | 0.09 |  | 3 | 10153 | 4.50 |
|  | 4 | 29 | 0.09 |  | 4 | 7212 | 2.98 |
|  | 5 | 0 | 0.10 |  | 5 | 11203 | 4.38 |
|  | 6 | 49 | 0.10 |  | 6 | 9784 | 2.27 |
|  | 7 | 0 | 0.10 |  | 8 | 7267 | 2.87 |
|  | 8 | 31 | 0.14 |  |  |  |  |
| Day 28 | | | | | | | |
| Control | 2 | 0 | 0.17 | Vax | 1 | 5033 | 2.61 |
|  | 4 | 0 | 0.15 |  | 2 | 3958 | 3.08 |
|  | 6 | 20 | 0.17 |  | 4 | 3960 | 3.58 |
| aCTLA4 | 1 | 7 | 0.23 | Vax + | 4 | 3460 | 2.44 |
|  | 2 | 0 | 0.18 | aCTLA4 | 5 | 5670 | 3.46 |
|  | 3 | 0 | 0.14 |  |  |  |  |

Figure 14A:
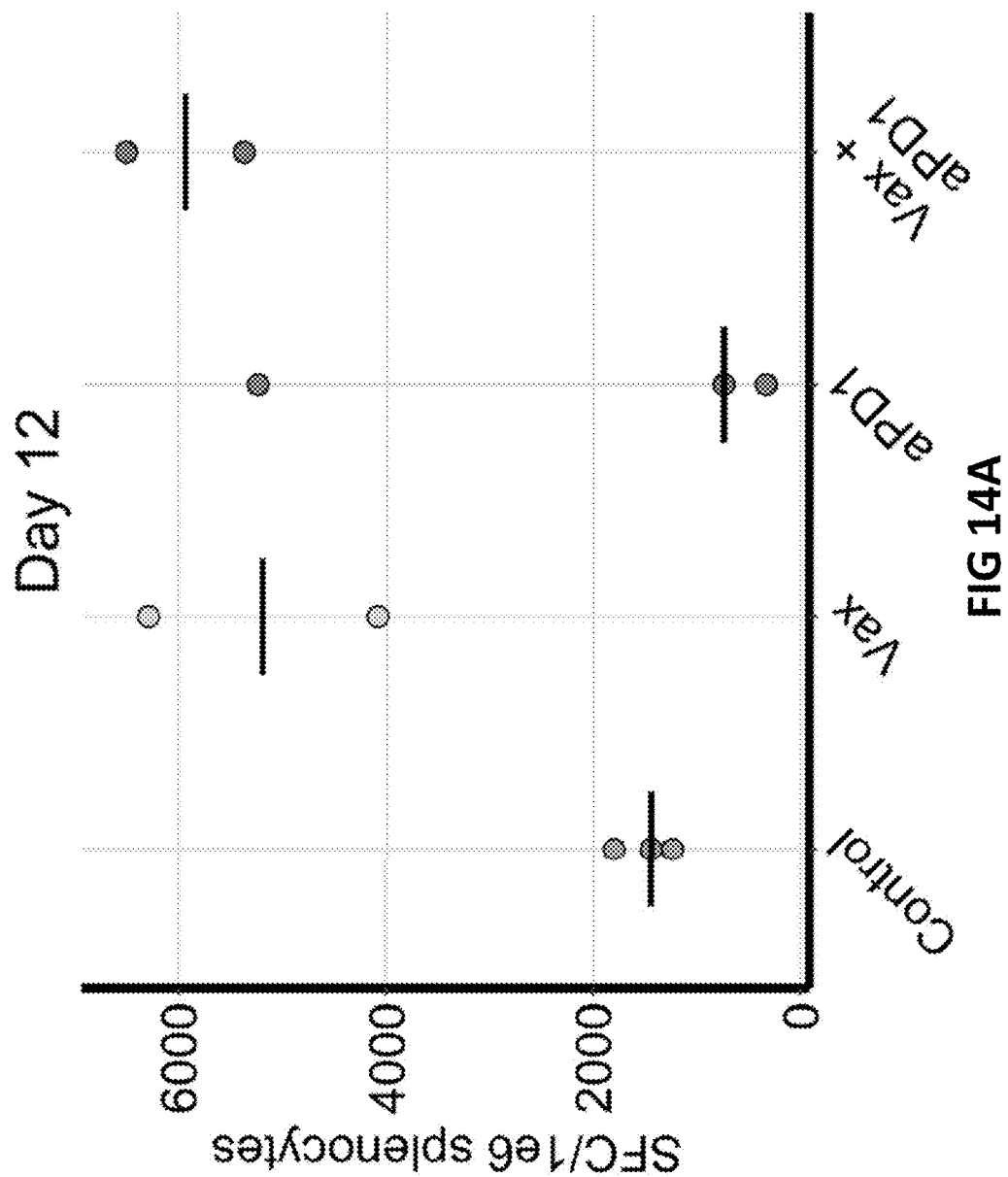
FIG. 14A illustrates antigen-specific T-cell responses following heterologous prime/boost in CT26 (Balb/c) tumor bearing mice. Mice were immunized with Ad5-GFP and boosted 15 days after the adenovirus prime with VEE-Luciferase srRNA formulated with MC3 LNP (Control) or primed with Ad5-UbAAY and boosted with VEE-UbAAY srRNA (Vax). Both the Control and Vax groups were also treated with an IgG control mAb. A separate group was administered the Ad5-GFP/VEE-Luciferase srRNA prime/boost in combination with anti-PD-1 (aPD1), while a fourth group received the Ad5-UbAAY/VEE-UbAAY srRNA prime/boost in combination with an anti-PD-1 mAb (Vax+aPD1). T-cell responses to the AH1 peptide were measured using IFN-gamma ELISPOT. Mice were sacrificed and spleens and lymph nodes collected at 12 days post immunization with adenovirus.
Figure 14B:
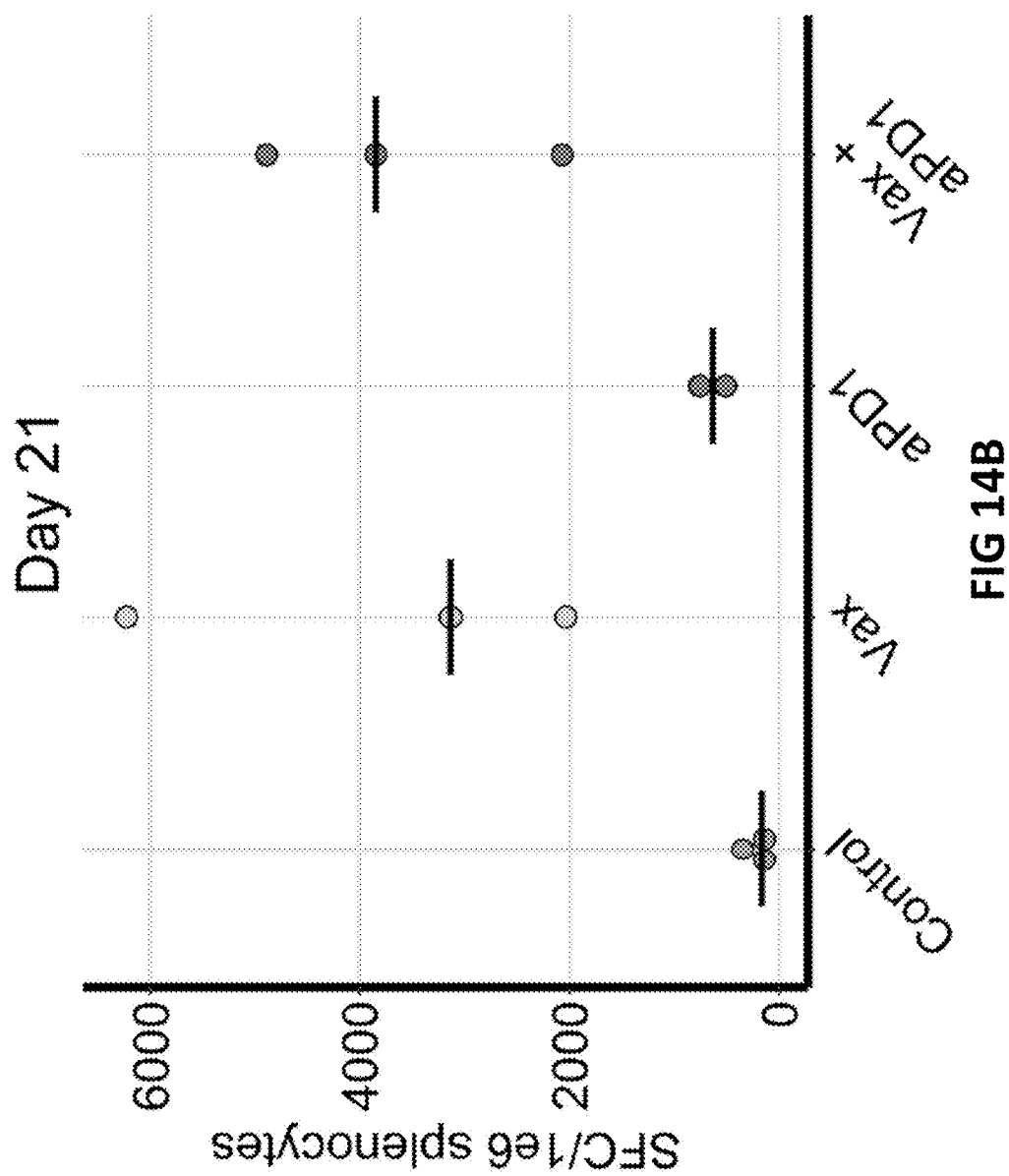
FIG. 14B illustrates antigen-specific T-cell responses following heterologous prime/boost in CT26 (Balb/c) tumor bearing mice. Mice were immunized with Ad5-GFP and boosted 15 days after the adenovirus prime with VEE-Luciferase srRNA formulated with MC3 LNP (Control) or primed with Ad5-UbAAY and boosted with VEE-UbAAY srRNA (Vax). Both the Control and Vax groups were also treated with an IgG control mAb. A separate group was administered the Ad5-GFP/VEE-Luciferase srRNA prime/boost in combination with anti-PD-1 (aPD1), while a fourth group received the Ad5-UbAAY/VEE-UbAAY srRNA prime/boost in combination with an anti-PD-1 mAb (Vax+aPD1). T-cell responses to the AH1 peptide were measured using IFN-gamma ELISPOT. Mice were sacrificed and spleens and lymph nodes collected at 12 days post immunization with adenovirus and 6 days post boost with srRNA (day 21 after prime).

In another implementation, similar results were observed after an Ad5-UbAAY prime and VEE-UbAAY srRNA boost in the CT26 mouse model. In one example, an AH1 antigen-specific response was observed after the Ad5-UbAAY prime (day 14) with a mean of 5187 SFCs per $10^6$ splenocytes measured in the ELISpot assay (FIG. 14A, Table 14) and 3799 SFCs per $10^6$ splenocytes measured in the ELISpot assay after the VEE-UbAAY srRNA boost (day 28) (FIG. 14B, Table 14).

TABLE 14

Immune monitoring after heterologous prime/boost in CT26 tumor mouse model.

| | Day 12 | | | Day 21 | |
|---|---|---|---|---|---|
| Group | Mouse | SFC/1e6 splenocytes | Group | Mouse | SFC/1e6 splenocytes |
| Control | 1 | 1799 | Control | 9 | 167 |
|  | 2 | 1442 |  | 10 | 115 |
|  | 3 | 1235 |  | 11 | 347 |
| aPD1 | 1 | 737 | aPD1 | 8 | 511 |
|  | 2 | 5230 |  | 11 | 758 |
|  | 3 | 332 | Vax | 9 | 3133 |
| Vax | 1 | 6287 |  | 10 | 2036 |
|  | 2 | 4086 |  | 11 | 6227 |

TABLE 14-continued

Immune monitoring after heterologous prime/boost in CT26 tumor mouse model.

| | Day 12 | | | Day 21 | |
|---|---|---|---|---|---|
| Group | Mouse | SFC/1e6 splenocytes | Group | Mouse | SFC/1e6 splenocytes |
| Vax + | 1 | 5363 | Vax+ | 8 | 3844 |
| aPD1 | 2 | 6500 | aPD1 | 9 | 2071 |
|  |  |  |  | 11 | 4888 |

XVII. ChAdV/srRNA Combination Tumor Model Evaluation

Various dosing protocols using ChAdV68 and self-replicating RNA (srRNA) were evaluated in murine CT26 tumor models.

XVII.a ChAdV/srRNA Combination Tumor Model Evaluation Methods and Materials

Tumor Injection

Balb/c mice were injected with the CT26 tumor cell line. 7 days after tumor cell injection, mice were randomized to the different study arms (28-40 mice per group) and treatment initiated. Balb/c mice were injected in the lower left abdominal flank with $10^6$ CT26 cells/animal. Tumors were allowed to grow for 7 days prior to immunization. The study arms are described in detail in Table 15.

TABLE 15

ChAdV/srRNA Combination Tumor Model Evaluation Study Arms

| Group | N | Treatment | Dose | Volume | Schedule | Route |
|---|---|---|---|---|---|---|
| 1 | 40 | ChAdV68 control | 1e11 vp | 2 × 50 uL | day 0 | IM |
|  |  | srRNA control | 10 ug | 50 uL | day 14, 28, 42 | IM |
|  |  | Anti-PD1 | 250 ug | 100 uL | 2 x/week (start day 0) | IP |
| 2 | 40 | ChAdV68 control | 1e11 vp | 2 × 50 uL | day 0 | IM |
|  |  | srRNA control | 10 ug | 50 uL | day 14, 28, 42 | IM |
|  |  | Anti-IgG | 250 ug | 100 uL | 2 x/week (start day 0) | IP |
| 3 | 28 | ChAdV68 vaccine | 1e11 vp | 2 × 50 uL | day 0 | IM |
|  |  | srRNA vaccine | 10 ug | 50 uL | day 14, 28, 42 | IM |
|  |  | Anti-PD1 | 250 ug | 100 uL | 2 x/week (start day 0) | IP |
| 4 | 28 | ChAdV68 vaccine | 1e11 vp | 2 × 50 uL | day 0 | IM |
|  |  | srRNA vaccine | 10 ug | 50 uL | day 14, 28, 42 | IM |
|  |  | Anti-IgG | 250 ug | 100 uL | 2 x/week (start day 0) | IP |

TABLE 15-continued

ChAdV/srRNA Combination Tumor Model Evaluation Study Arms

| Group | N | Treatment | Dose | Volume | Schedule | Route |
|---|---|---|---|---|---|---|
| 5 | 28 | srRNA vaccine | 10 ug | 50 uL | day 0, 28, 42 | IM |
|  |  | ChAdV68 vaccine | 1e11 vp | 2 × 50 uL | day 14 | IM |
|  |  | Anti-PD1 | 250 ug | 100 uL | 2 ×/week (start day 0) | IP |
| 6 | 28 | srRNA vaccine | 10 ug | 50 uL | day 0, 28, 42 | IM |
|  |  | ChAdV68 vaccine | 1e11 vp | 2 × 50 uL | day 14 | IM |
|  |  | Anti-IgG | 250 ug | 100 uL | 2 ×/week (start day 0) | IP |
| 7 | 40 | srRNA vaccine | 10 ug | 50 uL | day 0, 14, 28, 42 | IM |
|  |  | Anti-PD1 | 250 ug | 100 uL | 2 ×/week (start day 0) | IP |
| 8 | 40 | srRNA vaccine | 10 ug | 50 uL | day 0, 14, 28, 42 | IM |
|  |  | Anti-IgG | 250 ug | 100 uL | 2 ×/week (start day 0) | IP |

Immunizations

For srRNA vaccine, mice were injected with 10 ug of VEE-MAG25mer srRNA in 100 uL volume, bilateral intramuscular injection (50 uL per leg). For C68 vaccine, mice were injected with $1 \times 10^{11}$ viral particles (VP) of ChAdV68.5WTnt.MAG25mer in 100 uL volume, bilateral intramuscular injection (50 uL per leg). Animals were injected with anti-PD-1 (clone RMP1-14, BioXcell) or anti-IgG (clone MPC-11, BioXcell), 250 ug dose, 2 times per week, via intraperitoneal injection.

Splenocyte Dissociation

Spleen and lymph nodes for each mouse were pooled in 3 mL of complete RPMI (RPMI, 10% FBS, penicillin/streptomycin). Mechanical dissociation was performed using the gentleMACS Dissociator (Miltenyi Biotec), following manufacturer's protocol. Dissociated cells were filtered through a 40 micron filter and red blood cells were lysed with ACK lysis buffer (150 mM $NH_4Cl$, 10 mM $KHCO_3$, 0.1 mM $Na_2EDTA$). Cells were filtered again through a 30 micron filter and then resuspended in complete RPMI. Cells were counted on the Attune NxT flow cytometer (Thermo Fisher) using propidium iodide staining to exclude dead and apoptotic cells. Cell were then adjusted to the appropriate concentration of live cells for subsequent analysis.

Ex Vivo Enzyme-Linked Immunospot (ELISPOT) Analysis

ELISPOT analysis was performed according to ELISPOT harmonization guidelines {DOI: 10.1038/nprot.2015.068} with the mouse IFNg ELISpotPLUS kit (MABTECH). $5 \times 10^4$ splenocytes were incubated with 10 uM of the indicated peptides for 16 hours in 96-well IFNg antibody coated plates. Spots were developed using alkaline phosphatase. The reaction was timed for 10 minutes and was terminated by running plate under tap water. Spots were counted using an AID vSpot Reader Spectrum. For ELISPOT analysis, wells with saturation >50% were recorded as "too numerous to count". Samples with deviation of replicate wells >10% were excluded from analysis. Spot counts were then corrected for well confluency using the formula: spot count+ 2×(spot count×% confluence/[100%−% confluence]). Negative background was corrected by subtraction of spot counts in the negative peptide stimulation wells from the antigen stimulated wells. Finally, wells labeled too numerous to count were set to the highest observed corrected value, rounded up to the nearest hundred.

XVI.B ChAdV/srRNA Combination Evaluation in a CT26 Tumor Model

The immunogenicity and efficacy of the ChAdV68.5WTnt.MAG25mer/VEE-MAG25mer srRNA heterologous prime/boost or VEE-MAG25mer srRNA homologous prime/boost vaccines were evaluated in the CT26 mouse tumor model. Balb/c mice were injected with the CT26 tumor cell line. 7 days after tumor cell injection, mice were randomized to the different study arms and treatment initiated. The study arms are described in detail in Table 15 and more generally in Table 16.

TABLE 16

Prime/Boost Study Arms

| Group | Prime | Boost |
|---|---|---|
| 1 | Control | Control |
| 2 | Control + anti-PD-1 | Control + anti-PD-1 |
| 3 | ChAdV68.5WTnt.MAG25mer | VEE-MAG25mer srRNA |
| 4 | ChAdV68.5WTnt.MAG25mer + anti-PD-1 | VEE-MAG25mer srRNA + anti-PD-1 |
| 5 | VEE-MAG25mer srRNA | ChAdV68.5WTnt.MAG25mer |
| 6 | VEE-MAG25mer srRNA + anti-PD-1 | ChAdV68.5WTnt.MAG25mer + anti-PD-1 |
| 7 | VEE-MAG25mer srRNA | VEE-MAG25mer srRNA |
| 8 | VEE-MAG25mer srRNA + anti-PD-1 | VEE-MAG25mer srRNA + anti-PD-1 |

Spleens were harvested 14 days after the prime vaccination for immune monitoring. Tumor and body weight measurements were taken twice a week and survival was monitored. Strong immune responses relative to control were observed in all active vaccine groups.

Figure 16:
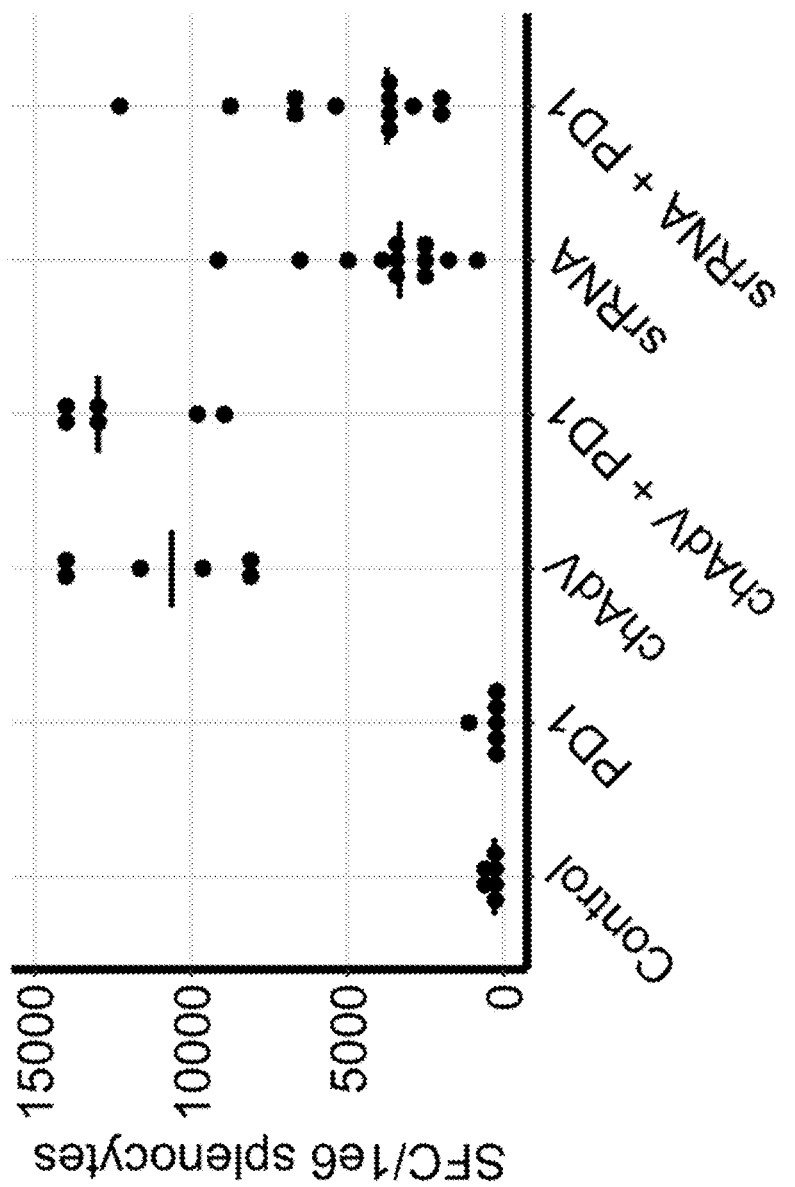
FIG. 16 illustrates cellular immune responses in a CT26 tumor model following a single immunization with either ChAdV6, ChAdV+anti-PD-1, srRNA, srRNA+anti-PD-1, or anti-PD-1 alone. Antigen-specific IFN-gamma production was measured in splenocytes for 6 mice from each group using ELISpot. Results are presented as spot forming cells (SFC) per $10^6$ splenocytes. Median for each group indicated by horizontal line. P values determined using the Dunnett's multiple comparison test; * $P<0.0001$, $P<0.001$, *$P<0.05$. ChAdV=ChAdV68.5WTnt.MAG25mer; srRNA=VEE-MAG25mer srRNA.

Median cellular immune responses of 10,630, 12,976, 3319, or 3745 spot forming cells (SFCs) per $10^6$ splenocytes were observed in ELISpot assays in mice immunized with ChAdV68.5WTnt.MAG25mer (ChAdV/group 3), ChAdV68.5WTnt.MAG25mer+anti-PD-1 (ChAdV+PD-1/group 4), VEE-MAG25mer srRNA (srRNA/median for groups 5 & 7 combined), or VEE-MAG25mer srRNA+anti-PD-1 (srRNA+PD-1/median for groups 6 & 8 combined), respectively, 14 days after the first immunization (FIG. 16 and Table 17). In contrast, the vaccine control (group 1) or vaccine control with anti-PD-1 (group 2) exhibited median cellular immune responses of 296 or 285 SFC per $10^6$ splenocytes, respectively.

TABLE 17

Cellular immune responses in a CT26 tumor model

| Treatment | Median SFC/$10^6$ Splenocytes |
|---|---|
| Control | 296 |
| PD1 | 285 |
| ChAdV68.5WTnt.MAG25mer (ChAdV) | 10630 |

TABLE 17-continued

Cellular immune responses in a CT26 tumor model

| Treatment | Median SFC/$10^6$ Splenocytes |
|---|---|
| ChAdV68.5WTnt.MAG25mer + PD1 (ChAdV + PD-1) | 12976 |
| VEE-MAG25mer srRNA (srRNA) | 3319 |
| VEE-MAG25mer srRNA + PD-1 (srRNA + PD1) | 3745 |

Figure 17:
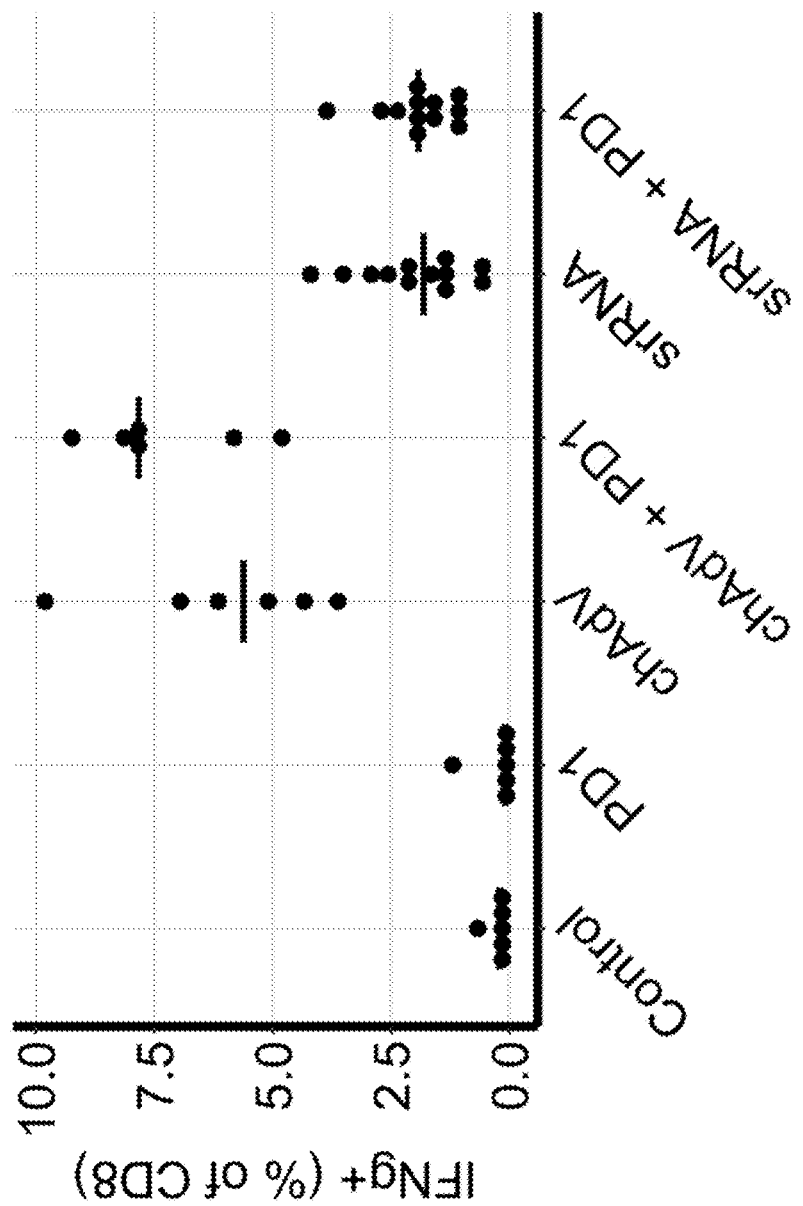
FIG. 17 illustrates CD8 T-Cell responses in a CT26 tumor model following a single immunization with either ChAdV6, ChAdV+anti-PD-1, srRNA, srRNA+anti-PD-1, or anti-PD-1 alone. Antigen-specific IFN-gamma production in CD8 T cells measured using ICS and results presented as antigen-specific CD8 T cells as a percentage of total CD8 T cells. Median for each group indicated by horizontal line. P values determined using the Dunnett's multiple comparison test; * $P<0.0001$, $P<0.001$, *$P<0.05$. ChAdV=ChAdV68.5WTnt.MAG25mer; srRNA=VEE-MAG25mer srRNA.

Consistent with the ELISpot data, 5.6, 7.8, 1.8 or 1.9% of CD8 T cells (median) exhibited antigen-specific responses in intracellular cytokine staining (ICS) analyses for mice immunized with ChAdV68.5WTnt.MAG25mer (ChAdV/ group 3), ChAdV68.5WTnt.MAG25mer+anti-PD-1 (ChAdV+PD-1/group 4), VEE-MAG25mer srRNA (srRNA/ median for groups 5 & 7 combined), or VEE-MAG25mer srRNA+anti-PD-1 (srRNA+PD-1/median for groups 6 & 8 combined), respectively, 14 days after the first immunization (FIG. 17 and Table 18). Mice immunized with the vaccine control or vaccine control combined with anti-PD-1 showed antigen-specific CD8 responses of 0.2 and 0.1%, respectively.

TABLE 18

CD8 T-Cell responses in a CT26 tumor model

| Treatment | Median % CD8 IFN-gamma Positive |
|---|---|
| Control | 0.21 |
| PD1 | 0.1 |
| ChAdV68.5WTnt.MAG25mer (ChAdV) | 5.6 |
| ChAdV68.5WTnt.MAG25mer + PD1 (ChAdV + PD-1) | 7.8 |
| VEE-MAG25mer srRNA (srRNA) | 1.8 |
| VEE-MAG25mer srRNA + PD-1 (srRNA + PD1) | 1.9 |

Figure 18:
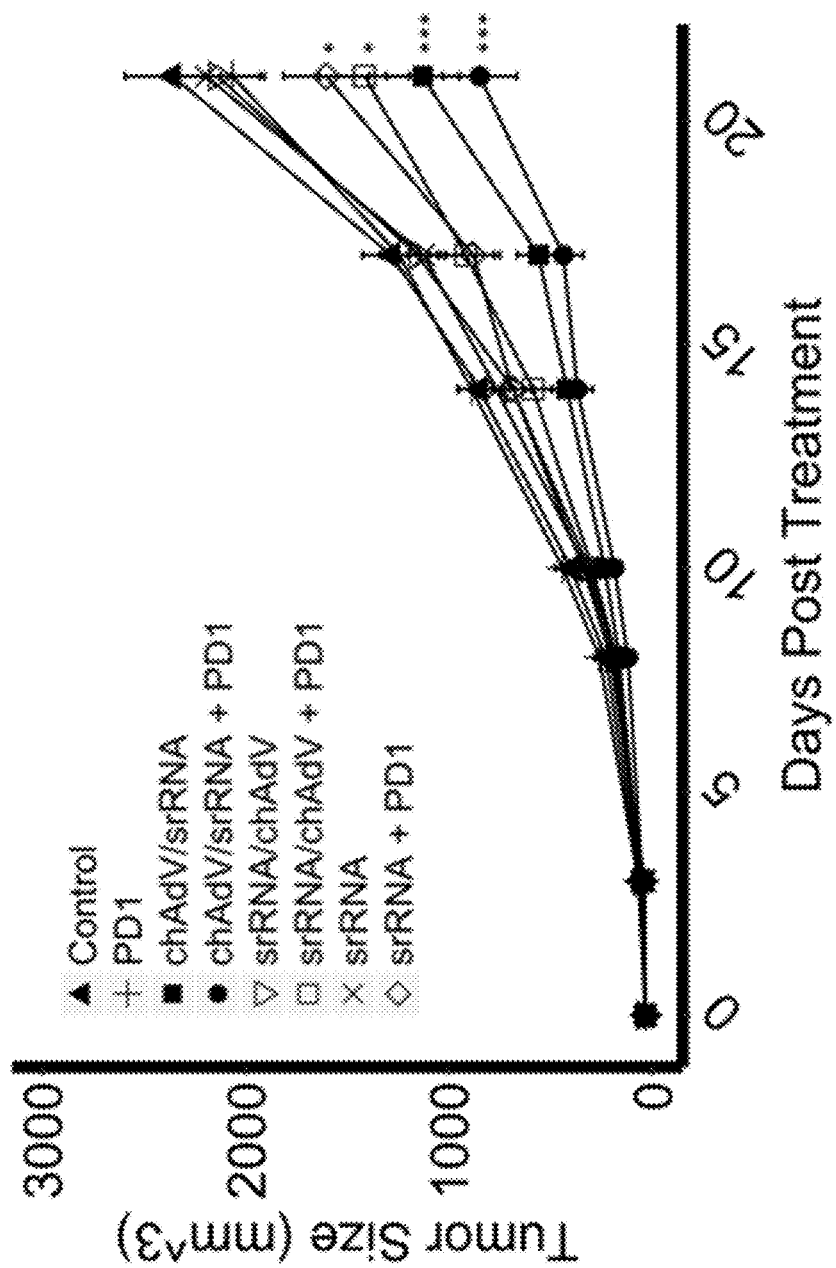
FIG. 18 illustrates tumor growth in a CT26 tumor model following immunization with a ChAdV/srRNA heterologous prime/boost, a srRNA/ChAdV heterologous prime/boost, or a srRNA/srRNA homologous primer/boost. Also illustrated in a comparison of the prime/boost immunizations with or without administration of anti-PD1 during prime and boost. Tumor volumes measured twice per week and mean tumor volumes presented for the first 21 days of the study. 22-28 mice per group at study initiation. Error bars represent standard error of the mean (SEM). P values determined using the Dunnett's test; * $P<0.0001$, $P<0.001$, *$P<0.05$. ChAdV=ChAdV68.5WTnt.MAG25mer; srRNA=VEE-MAG25mer srRNA.

Tumor growth was measured in the CT26 colon tumor model for all groups, and tumor growth up to 21 days after treatment initiation (28 days after injection of CT-26 tumor cells) is presented. Mice were sacrificed 21 days after treatment initiation based on large tumor sizes (>2500 mm$^3$); therefore, only the first 21 days are presented to avoid analytical bias. Mean tumor volumes at 21 days were 1129, 848, 2142, 1418, 2198 and 1606 mm$^3$ for ChAdV68.5WTnt.MAG25mer prime/VEE-MAG25mer srRNA boost (group 3), ChAdV68.5WTnt.MAG25mer prime/VEE-MAG25mer srRNA boost+anti-PD-1 (group 4), VEE-MAG25mer srRNA prime/ChAdV68.5WTnt.MAG25mer boost (group 5), VEE-MAG25mer srRNA prime/ChAdV68.5WTnt.MAG25mer boost+anti-PD-1 (group 6), VEE-MAG25mer srRNA prime/VEE-MAG25mer srRNA boost (group 7) and VEE-MAG25mer srRNA prime/VEE-MAG25mer srRNA boost+anti-PD-1 (group 8), respectively (FIG. 18 and Table 19). The mean tumor volumes in the vaccine control or vaccine control combined with anti-PD-1 were 2361 or 2067 mm$^3$, respectively. Based on these data, vaccine treatment with ChAdV68.5WTnt.MAG25mer/VEE-MAG25mer srRNA (group 3), ChAdV68.5WTnt.MAG25mer/VEE-MAG25mer srRNA+anti-PD-1 (group 4), VEE-MAG25mer srRNA/ChAdV68.5WTnt.MAG25mer+anti-PD-1 (group 6) and VEE-MAG25mer srRNA/VEE-MAG25mer srRNA+anti-PD-1 (group 8) resulted in a reduction of tumor growth at 21 days that was significantly different from the control (group 1).

TABLE 19

Tumor size at day 21 measured in the CT26 model

| Treatment | Tumor Size (mm$^3$) | SEM |
|---|---|---|
| Control | 2361 | 235 |
| PD1 | 2067 | 137 |
| chAdV/srRNA | 1129 | 181 |
| chAdV/srRNA + PD1 | 848 | 182 |
| srRNA/chAdV | 2142 | 233 |
| srRNA/chAdV + PD1 | 1418 | 220 |
| srRNA | 2198 | 134 |
| srRNA + PD1 | 1606 | 210 |

Figure 19:
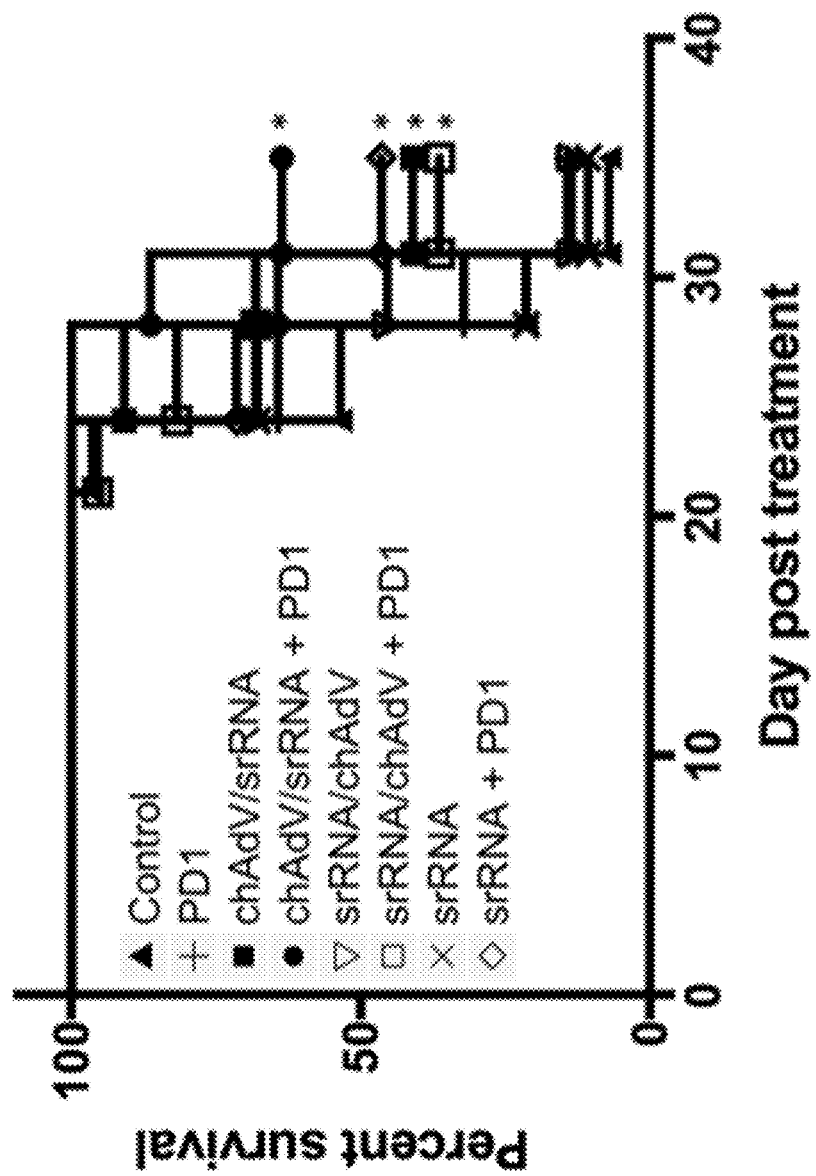
FIG. 19 illustrates survival in a CT26 tumor model following immunization with a ChAdV/srRNA heterologous prime/boost, a srRNA/ChAdV heterologous prime/boost, or a srRNA/srRNA homologous primer/boost. Also illustrated in a comparison of the prime/boost immunizations with or without administration of anti-PD1 during prime and boost. P values determined using the log-rank test; * $P<0.0001$, $P<0.001$, *$P<0.01$. ChAdV=ChAdV68.5WTnt.MAG25mer; srRNA=VEE-MAG25mer srRNA.

Survival was monitored for 35 days after treatment initiation in the CT-26 tumor model (42 days after injection of CT-26 tumor cells). Improved survival was observed after vaccination of mice with 4 of the combinations tested. After vaccination, 64%, 46%, 41% and 36% of mice survived with ChAdV68.5WTnt.MAG25mer prime/VEE-MAG25mer srRNA boost in combination with anti-PD-1 (group 4; P<0.0001 relative to control group 1), VEE-MAG25mer srRNA prime/VEE-MAG25mer srRNA boost in combination with anti-PD-1 (group 8; P=0.0006 relative to control group 1), ChAdV68.5WTnt.MAG25mer prime/VEE-MAG25mer srRNA boost (group 3; P=0.0003 relative to control group 1) and VEE-MAG25mer srRNA prime/ ChAdV68.5WTnt.MAG25mer boost in combination with anti-PD-1 (group 6; P=0.0016 relative to control group 1), respectively (FIG. 19 and Table 20). Survival was not significantly different from the control group 1 (≤14%) for the remaining treatment groups [VEE-MAG25mer srRNA prime/ChAdV68.5WTnt.MAG25mer boost (group 5), VEE-MAG25mer srRNA prime/VEE-MAG25mer srRNA boost (group 7) and anti-PD-1 alone (group 2)].

TABLE 20

Survival in the CT26 model

| Timepoint | Control | PD1 | chAdV/ srRNA | chAdV/ srRNA + PD1 | srRNA/ chAdV | srRNA/ chAdV + PD1 | srRNA | srRNA + PD1 |
|---|---|---|---|---|---|---|---|---|
| 0 | 100 | 100 | 100 | 100.00 | 100.00 | 100 | 100 | 100 |
| 21 | 96 | 100 | 100 | 100 | 100 | 95 | 100 | 100 |
| 24 | 54 | 64 | 91 | 100 | 68 | 82 | 68 | 71 |
| 28 | 21 | 32 | 68 | 86 | 45 | 68 | 21 | 64 |
| 31 | 7 | 14 | 41 | 64 | 14 | 36 | 11 | 46 |
| 35 | 7 | 14 | 41 | 64 | 14 | 36 | 11 | 46 |

In conclusion, ChAdV68.5WTnt.MAG25mer and VEE-MAG25mer srRNA elicited strong T-cell responses to mouse tumor antigens encoded by the vaccines, relative to control. Administration of a ChAdV68.5WTnt.MAG25mer prime and VEE-MAG25mer srRNA boost with or without co-administration of anti-PD-1, VEE-MAG25mer srRNA prime and ChAdV68.5WTnt.MAG25mer boost in combination with anti-PD-1 or administration of VEE-MAG25mer srRNA as a homologous prime boost immunization in combination with anti-PD-1 to tumor bearing mice resulted in improved survival.

XVIII. Non-Human Primate Studies

Various dosing protocols using ChAdV68 and self-replicating RNA (srRNA) were evaluated in non-human primates (NHP).

Materials and Methods

A priming vaccine was injected intramuscularly (IM) in each NHP to initiate the study (vaccine prime). One or more boosting vaccines (vaccine boost) were also injected intramuscularly in each NHP. Bilateral injections per dose were administered according to groups outlined in tables and summarized below.

Immunizations

Mamu-A*01 Indian rhesus macaques were immunized bilaterally with $1\times10^{12}$ viral particles ($5\times10^{11}$ viral particles per injection) of ChAdV68.5WTnt.MAG25mer, 30 ug of VEE-MAG25MER srRNA, 100 ug of VEE-MAG25mer srRNA or 300 ug of VEE-MAG25mer srRNA formulated in LNP-1 or LNP-2. Vaccine boosts of 30 ug, 100 ug or 300 ug VEE-MAG25mer srRNA were administered intramuscularly at the indicated time after prime vaccination.

Immune Monitoring

PBMCs were isolated at indicated times after prime vaccination using Lymphocyte Separation Medium (LSM, MP Biomedicals) and LeucoSep separation tubes (Greiner Bio-One) and resuspended in RPMI containing 10% FBS and penicillin/streptomycin. Cells were counted on the Attune NxT flow cytometer (Thermo Fisher) using propidium iodide staining to exclude dead and apoptotic cells. Cell were then adjusted to the appropriate concentration of live cells for subsequent analysis. For each monkey in the studies, T cell responses were measured using ELISpot or flow cytometry methods. T cell responses to 6 different rhesus macaque Mamu-A*01 class I epitopes encoded in the vaccines were monitored from PBMCs by measuring induction of cytokines, such as IFN-gamma, using ex vivo enzyme-linked immunospot (ELISpot) analysis. ELISpot analysis was performed according to ELISPOT harmonization guidelines {DOI: 10.1038/nprot.2015.068} with the monkey IFNg ELISpotPLUS kit (MABTECH). 200,000 PBMCs were incubated with 10 uM of the indicated peptides for 16 hours in 96-well IFNg antibody coated plates. Spots were developed using alkaline phosphatase. The reaction was timed for 10 minutes and was terminated by running plate under tap water. Spots were counted using an AID vSpot Reader Spectrum. For ELISPOT analysis, wells with saturation >50% were recorded as "too numerous to count". Samples with deviation of replicate wells >10% were excluded from analysis. Spot counts were then corrected for well confluency using the formula: spot count+ 2×(spot count×% confluence/[100%−% confluence]). Negative background was corrected by subtraction of spot counts in the negative peptide stimulation wells from the antigen stimulated wells. Finally, wells labeled too numerous to count were set to the highest observed corrected value, rounded up to the nearest hundred.

Specific CD4 and CD8 T cell responses to 6 different rhesus macaque Mamu-A*01 class I epitopes encoded in the vaccines were monitored from PBMCs by measuring induction of intracellular cytokines, such as IFN-gamma, using flow cytometry. The results from both methods indicate that cytokines were induced in an antigen-specific manner to epitopes.

Immunogenicity in Rhesus Macaques

This study was designed to (a) evaluate the immunogenicity and preliminary safety of VEE-MAG25mer srRNA 30 μg and 100 μg doses as a homologous prime/boost or heterologous prime/boost in combination with ChAdV68.5WTnt.MAG25mer; (b) compare the immune responses of VEE-MAG25mer srRNA in lipid nanoparticles using LNP1 versus LNP2; (c) evaluate the kinetics of T-cell responses to VEE-MAG25mer srRNA and ChAdV68.5WTnt.MAG25mer immunizations.

The study arm was conducted in Mamu-A*01 Indian rhesus macaques to demonstrate immunogenicity. Select antigens used in this study are only recognized in Rhesus macaques, specifically those with a Mamu-A*01 MHC class I haplotype. Mamu-A*01 Indian rhesus macaques were randomized to the different study arms (6 macaques per group) and administered an IM injection bilaterally with either ChAdV68.5WTnt.MAG25mer or VEE-MAG25mer srRNA vector encoding model antigens that includes multiple Mamu-A*01 restricted epitopes. The study arms were as described below.

TABLE 21

Non-GLP immunogenicity study in Indian Rhesus Macaques

| Group | Prime | Boost 1 | Boost 2 |
|---|---|---|---|
| 1 | VEE-MAG25mer srRNA-LNP1(30 μg) | VEE-MAG25mer srRNA-LNP1 (30 μg) | VEE-MAG25mer srRNA-LNP1 (30 μg) |
| 2 | VEE-MAG25mer srRNA-LNP1 (100 μg) | VEE-MAG25mer srRNA-LNP1 (100 μg) | VEE-MAG25mer srRNA-LNP1 (100 μg) |
| 3 | VEE-MAG25mer srRNA-LNP2 (100 μg) | VEE-MAG25mer srRNA-LNP2 (100 μg) | VEE-MAG25mer srRNA-LNP2 (100 μg) |
| 4 | ChAdV68.5WTnt.MAG25mer | VEE-MAG25mer srRNA-LNP1 (100 μg) | VEE-MAG25mer srRNA-LNP1 (100 μg) |

PBMCs were collected prior to immunization and on weeks 1, 2, 3, 4, 5, 6, 8, 9, and 10 after the initial immunization for immune monitoring.

Results

Antigen-specific cellular immune responses in peripheral blood mononuclear cells (PBMCs) were measured to six different Mamu-A*01 restricted epitopes prior to immunization and 1, 2, 3, 4, 5, 6, 8, 9, and 10 weeks after the initial immunization. Animals received a boost immunization with VEE-MAG25mer srRNA on weeks 4 and 8 with either 30 μg or 100 μg doses, and either formulated with LNP1 or LNP2, as described in Table 21. Combined immune responses to all six epitopes were plotted for each immune monitoring timepoint (FIG. 20A-D and Tables 22-25).

Figure 20A:
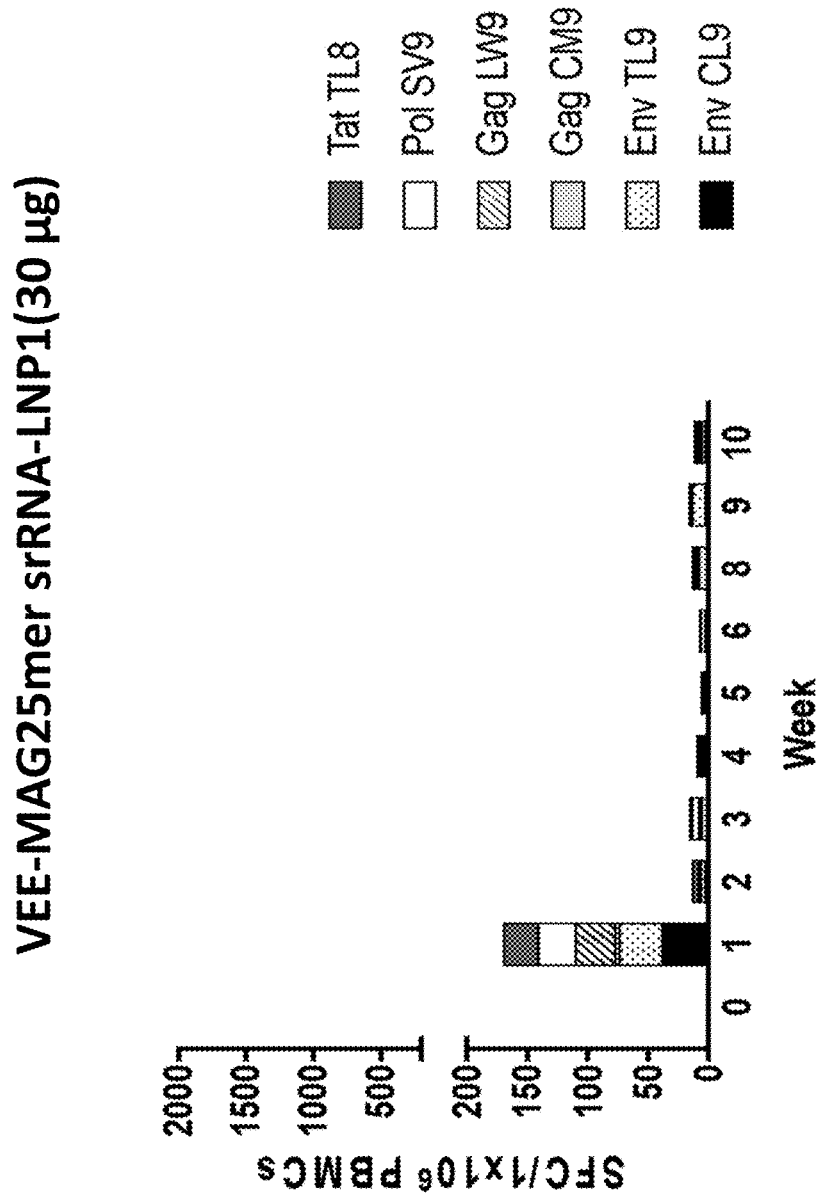
FIG. 20A illustrates antigen-specific cellular immune responses measured using ELISpot. Antigen-specific IFN-gamma production to six different mamu A01 restricted epitopes was measured in PBMCs for the VEE-MAG25mer srRNA-LNP1(30 µg) using ELISpot 1, 2, 3, 4, 5, 6, 8, 9, or 10 weeks after the initial immunization (6 rhesus macaques per group). Results are presented as mean spot forming cells (SFC) per $10^6$ PBMCs for each epitope in a stacked bar graph format. Values for each animal were normalized to the levels at pre-bleed (week 0).
Figure 20B:
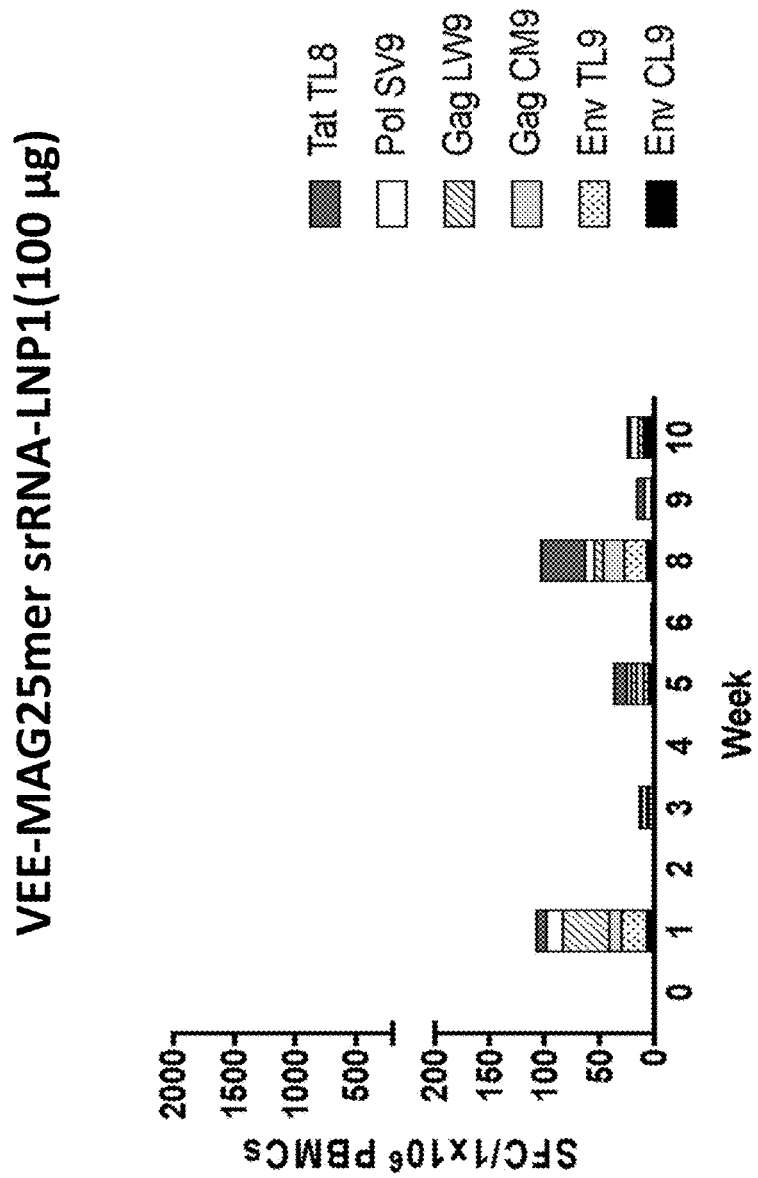
FIG. 20B illustrates antigen-specific cellular immune responses measured using ELISpot. Antigen-specific IFN-gamma production to six different mamu A01 restricted epitopes was measured in PBMCs for the VEE-MAG25mer srRNA-LNP1(100 µg) using ELISpot 1, 2, 3, 4, 5, 6, 8, 9, or 10 weeks after the initial immunization (6 rhesus macaques per group). Results are presented as mean spot forming cells (SFC) per 10⁶ PBMCs for each epitope in a stacked bar graph format. Values for each animal were normalized to the levels at pre-bleed (week 0)
Figure 20C:
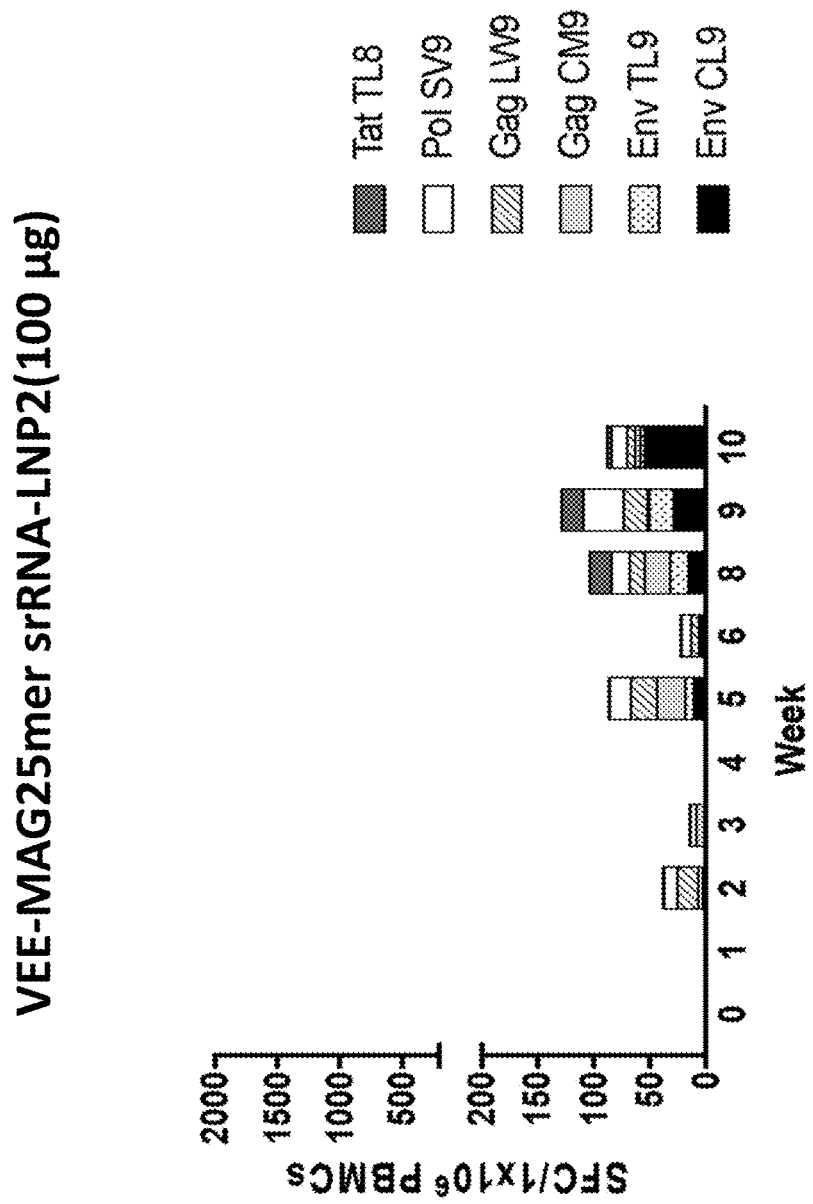
FIG. 20C illustrates antigen-specific cellular immune responses measured using ELISpot. Antigen-specific IFN-gamma production to six different mamu A01 restricted epitopes was measured in PBMCs for the VEE-MAG25mer srRNA-LNP2(100 μg) homologous prime/boost using ELISpot 1, 2, 3, 4, 5, 6, 8, 9, or 10 weeks after the initial immunization (6 rhesus macaques per group). Results are presented as mean spot forming cells (SFC) per 10⁶ PBMCs for each epitope in a stacked bar graph format. Values for each animal were normalized to the levels at pre-bleed (week 0).

Combined antigen-specific immune responses were observed at all measurements with 170, 14, 15, 11, 7, 8, 14, 17, 12 SFCs per $10^6$ PBMCs (six epitopes combined) 1, 2, 3, 4, 5, 6, 8, 9, or 10 weeks after an initial VEE-MAG25mer srRNA-LNP1(30 μg) prime immunization, respectively (FIG. 20A). Combined antigen-specific immune responses were observed at all measurements with 108, −3, 14, 1, 37, 4, 105, 17, 25 SFCs per $10^6$ PBMCs (six epitopes combined) 1, 2, 3, 4, 5, 6, 8, 9, or 10 weeks after an initial VEE-MAG25mer srRNA-LNP1(100 μg) prime immunization, respectively (FIG. 20B). Combined antigen-specific immune responses were observed at all measurements with −17, 38, 14, −2, 87, 21, 104, 129, 89 SFCs per $10^6$ PBMCs (six epitopes combined) 1, 2, 3, 4, 5, 6, 8, 9, or 10 weeks after an initial VEE-MAG25mer srRNA-LNP2(100 μg) prime immunization, respectively (FIG. 20C). Negative values are a result of normalization to pre-bleed values for each epitope/animal.

Figure 20D:
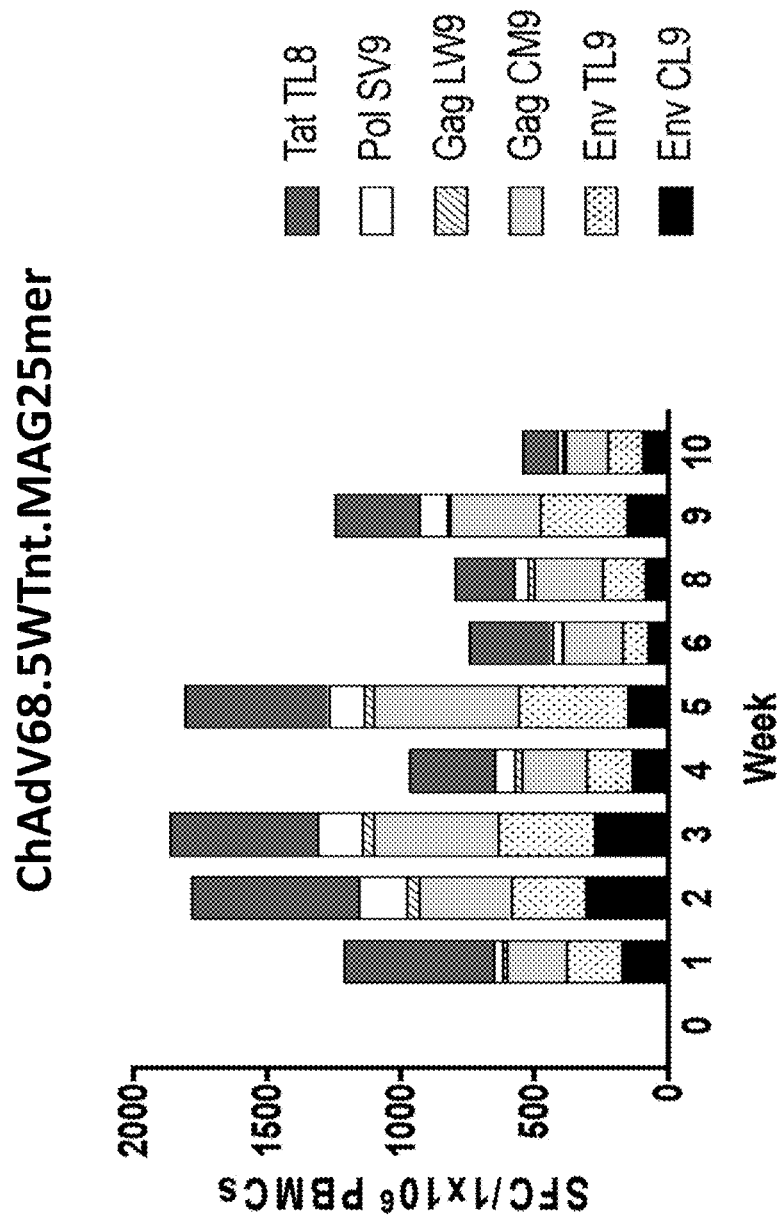
FIG. 20D illustrates antigen-specific cellular immune responses measured using ELISpot. Antigen-specific IFN-gamma production to six different mamu A01 restricted epitopes was measured in PBMCs for the ChAdV68.5WTnt.MAG25mer/VEE-MAG25mer srRNA heterologous prime/boost group using ELISpot 1, 2, 3, 4, 5, 6, 8, 9, or 10 weeks after the initial immunization (6 rhesus macaques per group). Results are presented as mean spot forming cells (SFC) per 10⁶ PBMCs for each epitope in a stacked bar graph format. Values for each animal were normalized to the levels at pre-bleed (week 0).

Combined antigen-specific immune responses were observed at all measurements with 1218, 1784, 1866, 973, 1813, 747, 797, 1249, and 547 SFCs per $10^6$ PBMCs (six epitopes combined) 1, 2, 3, 4, 5, 6, 8, 9, or 10 weeks after an initial ChAdV68.5WTnt.MAG25mer prime immunization, respectively (FIG. 20D). The immune response showed the expected profile with peak immune responses measured ~2-3 weeks after the prime immunization followed by a contraction in the immune response after 4 weeks. Combined antigen-specific cellular immune responses of 1813 SFCs per $10^6$ PBMCs (six epitopes combined) were measured 5 weeks after the initial immunization with ChAdV68.5WTnt.MAG25mer (i.e., 1 week after the first boost with VEE-MAG25mer srRNA). The immune response measured 1 week after the first boost with VEE-MAG25mer srRNA (week 5) was comparable to the peak immune response measured for the ChAdV68.5WTnt.MAG25mer prime immunization (week 3) (FIG. 20D). Combined antigen-specific cellular immune responses of 1249 SFCs per $10^6$ PBMCs (six epitopes combined) was measured 9 weeks after the initial immunization with ChAdV68.5WTnt.MAG25mer, respectively (i.e., 1 week after the second boost with VEE-MAG25mer srRNA). The immune responses measured 1 week after the second boost with VEE-MAG25mer srRNA (week 9) was ~2-fold higher than that measured just before the boost immunization (FIG. 20D).

TABLE 22

Mean spot forming cells (SFC) per $10^6$ PBMCs for each epitope ± SEM for VEE-MAG25mer srRNA-LNP1(30 μg) (Group 1)

| | Antigen | | | | | |
|---|---|---|---|---|---|---|
| Wk | Env CL9 | Env TL9 | Gag CM9 | Gag LW9 | Pol SV9 | Tat TL8 |
| 1 | 0 ± 0 | 0 ± 0 | 0 ± 0 | 0 ± 0 | 0 ± 0 | 0 ± 0 |
| 2 | 39.7 ± 22.7 | 35.4 ± 25.1 | 3.2 ± 3.6 | 33 ± 28.1 | 30.9 ± 20.3 | 28.3 ± 17.5 |
| 3 | 2 ± 2.4 | 0.2 ± 1.8 | 1.8 ± 2.4 | 3.7 ± 1.9 | 1.7 ± 2.8 | 4.9 ± 2.3 |
| 4 | 1 ± 1.8 | 0.3 ± 1.2 | 5.5 ± 3.6 | 2.3 ± 2.2 | 5.7 ± 2.7 | 0.8 ± 0.8 |
| 5 | 0.5 ± 0.9 | 1.4 ± 3.8 | 3.1 ± 1.6 | 2.3 ± 2.7 | 1.9 ± 2 | 1.4 ± 1.2 |
| 6 | 1.9 ± 1.8 | −0.3 ± 3 | 1.7 ± 1.2 | 1.4 ± 1.4 | 0.8 ± 1.1 | 1.1 ± 1 |
| 8 | −0.4 ± 0.8 | −0.9 ± 2.9 | 0.5 ± 1.3 | 3 ± 1.1 | 2.2 ± 2.1 | 3.7 ± 2 |
| 9 | 1 ± 1.7 | 1.2 ± 4.2 | 7.2 ± 3.9 | 0.5 ± 0.7 | 1.6 ± 3 | 3 ± 1 |
| 10 | 3.8 ± 1.8 | 11 ± 5 | −1.1 ± 1.1 | 1.9 ± 0.9 | 1.3 ± 1.6 | 0.2 ± 0.5 |

TABLE 23

Mean spot forming cells (SFC) per $10^6$ PBMCs for each epitope ± SEM for VEE-MAG25mer srRNA-LNP1(100 μg) (Group 2)

| | Antigen | | | | | |
|---|---|---|---|---|---|---|
| Wk | Env CL9 | Env TL9 | Gag CM9 | Gag LW9 | Pol SV9 | Tat TL8 |
| 1 | 0 ± 0 | 0 ± 0 | 0 ± 0 | 0 ± 0 | 0 ± 0 | 0 ± 0 |
| 2 | 7.9 ± 17.2 | 23.2 ± 17.4 | 11.4 ± 4.9 | 41.7 ± 16.5 | 15 ± 13.5 | 8.9 ± 6.2 |
| 3 | −3.1 ± 4.6 | −7.2 ± 6.5 | 2.3 ± 2.3 | −0.3 ± 2.7 | 2.7 ± 5.1 | 2.2 ± 1.4 |
| 4 | 1.9 ± 3.8 | −6.2 ± 7.6 | 10.5 ± 4.1 | 1.2 ± 2.9 | 5.6 ± 4.9 | 1.1 ± 0.8 |
| 5 | −2.6 ± 7 | −8 ± 5.9 | 1.5 ± 1.7 | 6.4 ± 2.3 | 0.7 ± 4.3 | 3.3 ± 1.3 |
| 6 | 6.3 ± 6.3 | 4.4 ± 8.3 | 6.6 ± 4.4 | 5.2 ± 5.2 | 3.9 ± 5 | 10.8 ± 6.9 |
| 8 | −3.6 ± 7.2 | −6.8 ± 7.3 | −0.8 ± 1.2 | 3.4 ± 4.2 | 6.4 ± 7.5 | 5.7 ± 2.7 |
| 9 | 8.1 ± 2.4 | 20.6 ± 23.4 | 18.9 ± 5.7 | 8.1 ± 8.9 | 9 ± 11.2 | 40 ± 17.6 |
| 10 | 3.1 ± 8 | −3.9 ± 8.5 | 3.3 ± 1.8 | 0.6 ± 2.9 | 7.4 ± 6.4 | 6.1 ± 2.5 |

TABLE 24

Mean spot forming cells (SFC) per $10^6$ PBMCs for each epitope ± SEM for VEE-MAG25mer srRNA-LNP2(100 µg) (Group 3)

| | Antigen | | | | | |
|---|---|---|---|---|---|---|
| Wk | Env CL9 | Env TL9 | Gag CM9 | Gag LW9 | Pol SV9 | Tat TL8 |
| 1 | 0 ± 0 | 0 ± 0 | 0 ± 0 | 0 ± 0 | 0 ± 0 | 0 ± 0 |
| 2 | −5.9 ± 3.8 | −0.3 ± 0.5 | −0.5 ± 1.5 | −5.7 ± 6.1 | −1 ± 1.3 | −3.2 ± 5.5 |
| 3 | 0.7 ± 5.2 | 3.4 ± 2.4 | 4.2 ± 4.6 | 18.3 ± 15.5 | 11.9 ± 5.1 | −0.4 ± 8.2 |
| 4 | −3.8 ± 5.5 | 2.3 ± 1.8 | 11.3 ± 6.1 | −3.1 ± 5.6 | 8.5 ± 4 | −1.5 ± 6.1 |
| 5 | −3.7 ± 5.7 | −0.1 ± 0.7 | −0.2 ± 1.6 | 3.4 ± 8.5 | 3 ± 3.1 | −4.6 ± 5 |
| 6 | 12.3 ± 15 | 7.8 ± 4.9 | 24.7 ± 19.8 | 23.2 ± 22.5 | 18.7 ± 15.8 | 0.5 ± 6.2 |
| 8 | 5.9 ± 12.3 | −0.1 ± 0.7 | −0.5 ± 1.3 | 8.8 ± 14.4 | 8.7 ± 8 | −1.3 ± 4 |
| 9 | 16.1 ± 13.4 | 16.5 ± 4 | 22.9 ± 4.2 | 13 ± 13.2 | 16.4 ± 7.8 | 19.6 ± 9.2 |
| 10 | 29.9 ± 21.8 | 22 ± 19.5 | 0.5 ± 2.6 | 22.2 ± 22.6 | 35.3 ± 15.8 | 19.4 ± 17.3 |

TABLE 25

Mean spot forming cells (SFC) per $10^6$ PBMCs for each epitope ± SEM for ChAdV68.5WTnt.MAG25mer prime

| | Antigen | | | | | |
|---|---|---|---|---|---|---|
| Wk | Env CL9 | Env TL9 | Gag CM9 | Gag LW9 | Pol SV9 | Tat TL8 |
| 1 | 178 ± 68.7 | 206.5 ± 94.8 | 221.2 ± 120 | 15.4 ± 16.7 | 33.3 ± 25.9 | 563.5 ± 174.4 |
| 2 | 311.2 ± 165.5 | 278.8 ± 100.9 | 344.6 ± 110.8 | 46.3 ± 13.5 | 181.6 ± 76.8 | 621.4 ± 220.9 |
| 3 | 277.3 ± 101.1 | 359.6 ± 90.5 | 468.2 ± 106.6 | 41.7 ± 11.1 | 169.8 ± 57.8 | 549.4 ± 115.7 |
| 4 | 140 ± 46.5 | 169.6 ± 46.8 | 239.4 ± 37 | 26.5 ± 11.4 | 75 ± 31.6 | 322.2 ± 50.7 |
| 5 | 155.6 ± 62.1 | 406.7 ± 96.4 | 542.7 ± 143.3 | 35.1 ± 16.6 | 134.2 ± 53.7 | 538.5 ± 91.9 |
| 6 | 78.9 ± 42.5 | 95.5 ± 29.4 | 220.9 ± 75.3 | −1.4 ± 5.3 | 43.4 ± 19.6 | 308.1 ± 42.6 |
| 8 | 88.4 ± 30.4 | 162.1 ± 30.3 | 253.4 ± 78.6 | 21.4 ± 11.2 | 53.7 ± 22.3 | 217.8 ± 45.2 |
| 9 | 158.5 ± 69 | 322.3 ± 87.2 | 338.2 ± 137.1 | 5.6 ± 12.4 | 109.2 ± 17.9 | 314.8 ± 43.4 |
| 10 | 97.3 ± 32.5 | 133.2 ± 27 | 154.9 ± 59.2 | 10 ± 6 | 26 ± 16.7 | 125.5 ± 27.7 |

Results

Figure 21:
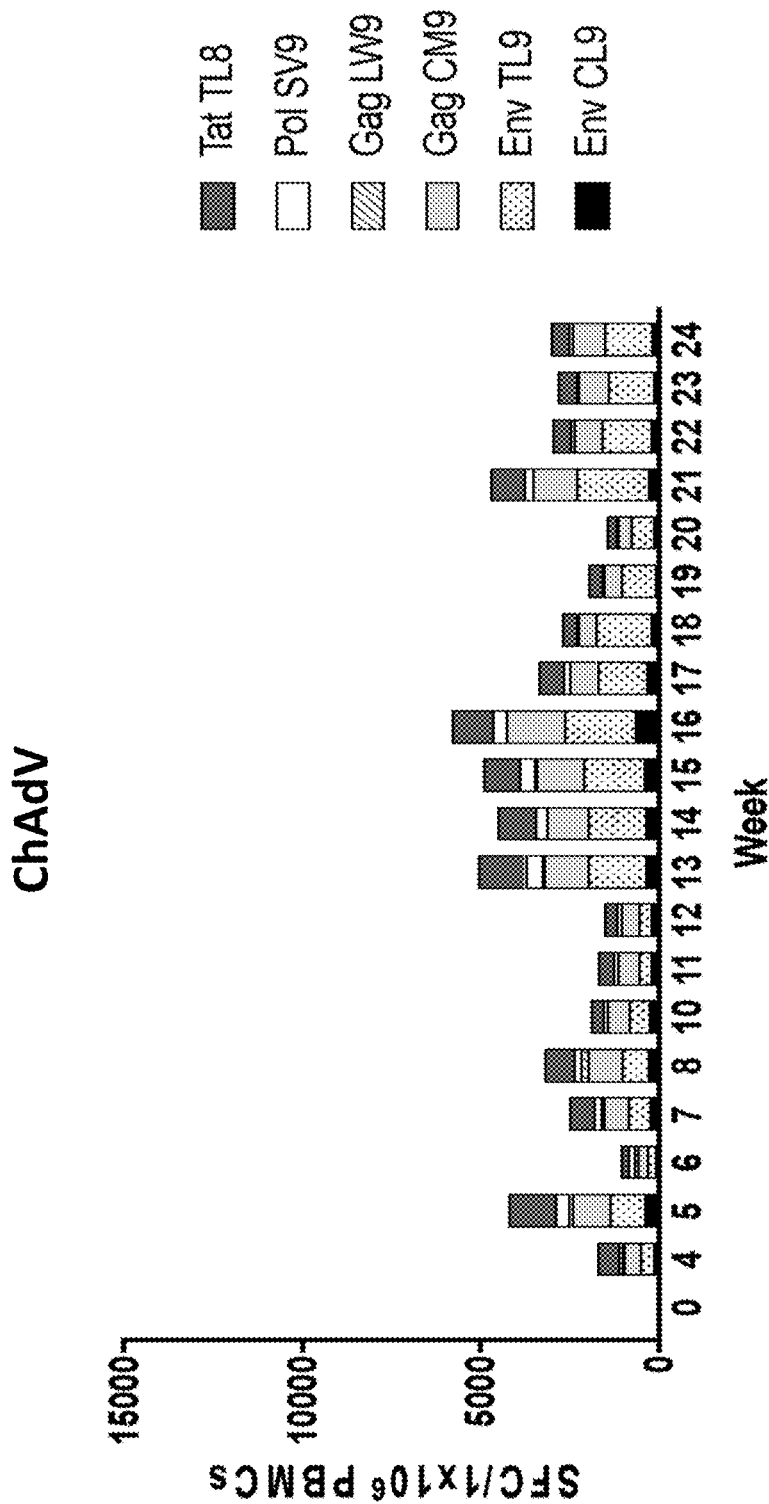
FIG. 21 shows antigen-specific cellular immune response measured using ELISpot. Antigen-specific IFN-gamma production to six different mamu A01 restricted epitopes was measured in PBMCs after immunization with the ChAdV68.5WTnt.MAG25mer/VEE-MAG25mer srRNA heterologous prime/boost regimen using ELISpot prior to immunization and 4, 5, 6, 7, 8, 10, 11, 12, 13, 14, 15, 16, 17, 18, 19, 20, 21, 22, 23 or 24 weeks after the initial immunization. Results are presented as mean spot forming cells (SFC) per 10⁶ PBMCs for each epitope (6 rhesus macaques per group) in a stacked bar graph format.

Mamu-A*01 Indian rhesus macaques were immunized with ChAdV68.5-WTnt.MAG25mer. Antigen-specific cellular immune responses in peripheral blood mononuclear cells (PBMCs) were measured to six different Mamu-A*01 restricted epitopes prior to immunization and 4, 5, 6, 7, 8, 10, 11, 12, 13, 14, 15, 16, 17, 18, 19, 20, 21, 22, 23 or 24 weeks after the initial immunization (FIG. 21 and Table 27). Animals received boost immunizations with VEE-MAG25mer srRNA using the LNP2 formulation on weeks 4, 12, and 20. Combined antigen-specific immune responses of 1750, 4225, 1100, 2529, 3218, 1915, 1708, 1561, 5077, 4543, 4920, 5820, 3395, 2728, 1996, 1465, 4730, 2984, 2828, or 3043 SFCs per $10^6$ PBMCs (six epitopes combined) were measured 4, 5, 6, 7, 8, 10, 11, 12, 13, 14, 15, 16, 17, 18, 19, 20, 21, 22, 23 or 24 weeks after the initial immunization with ChAdV68.5WTnt.MAG25mer (FIG. 21). Immune responses measured 1 week after the second boost immunization (week 13) with VEE-MAG25mer srRNA were ~3-fold higher than that measured just before the boost immunization (week 12). Immune responses measured 1 week after the third boost immunization (week 21) with VEE-MAG25mer srRNA, were ~3-fold higher than that measured just before the boost immunization (week 20), similar to the response observed for the second boost.

Figure 22:
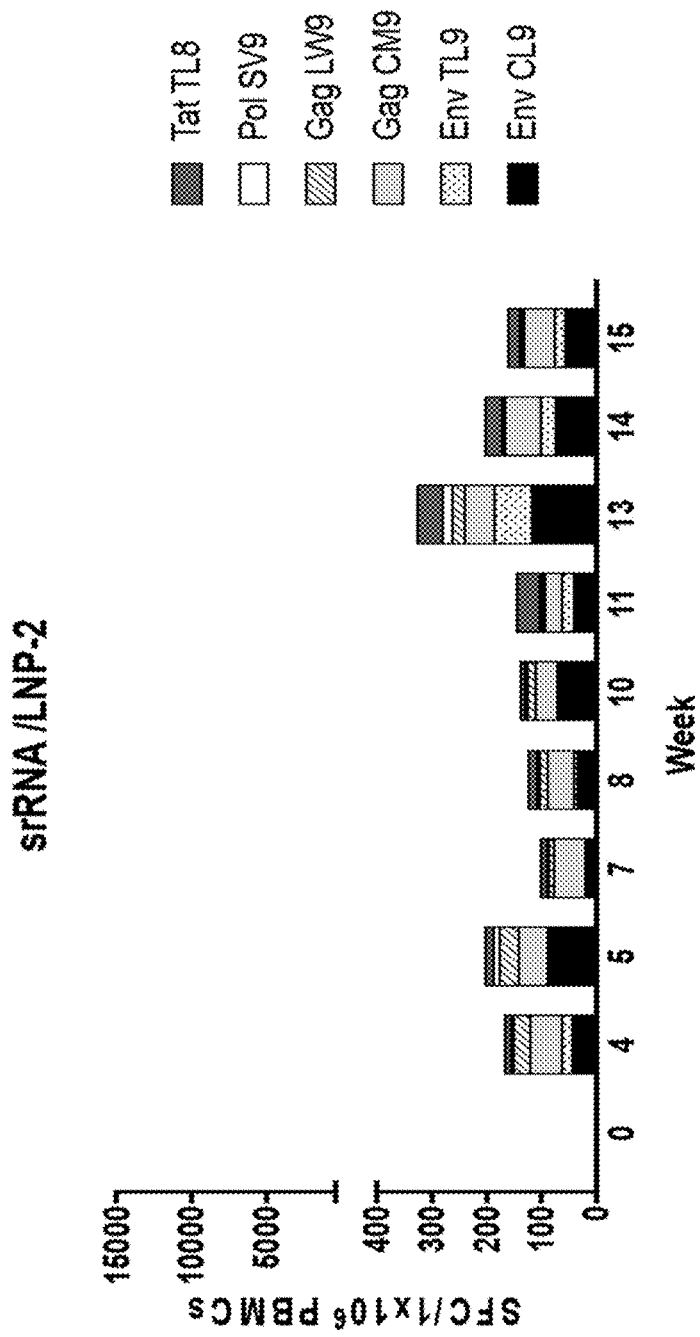
FIG. 22 shows antigen-specific cellular immune response measured using ELISpot. Antigen-specific IFN-gamma production to six different mamu A01 restricted epitopes was measured in PBMCs after immunization with the VEE-MAG25mer srRNA LNP2 homologous prime/boost regimen using ELISpot prior to immunization and 4, 5, 6, 7, 8, 10, 11, 12, 13, 14, or 15 weeks after the initial immunization. Results are presented as mean spot forming cells (SFC) per 10⁶ PBMCs for each epitope (6 rhesus macaques per group) in a stacked bar graph format.
Figure 23:
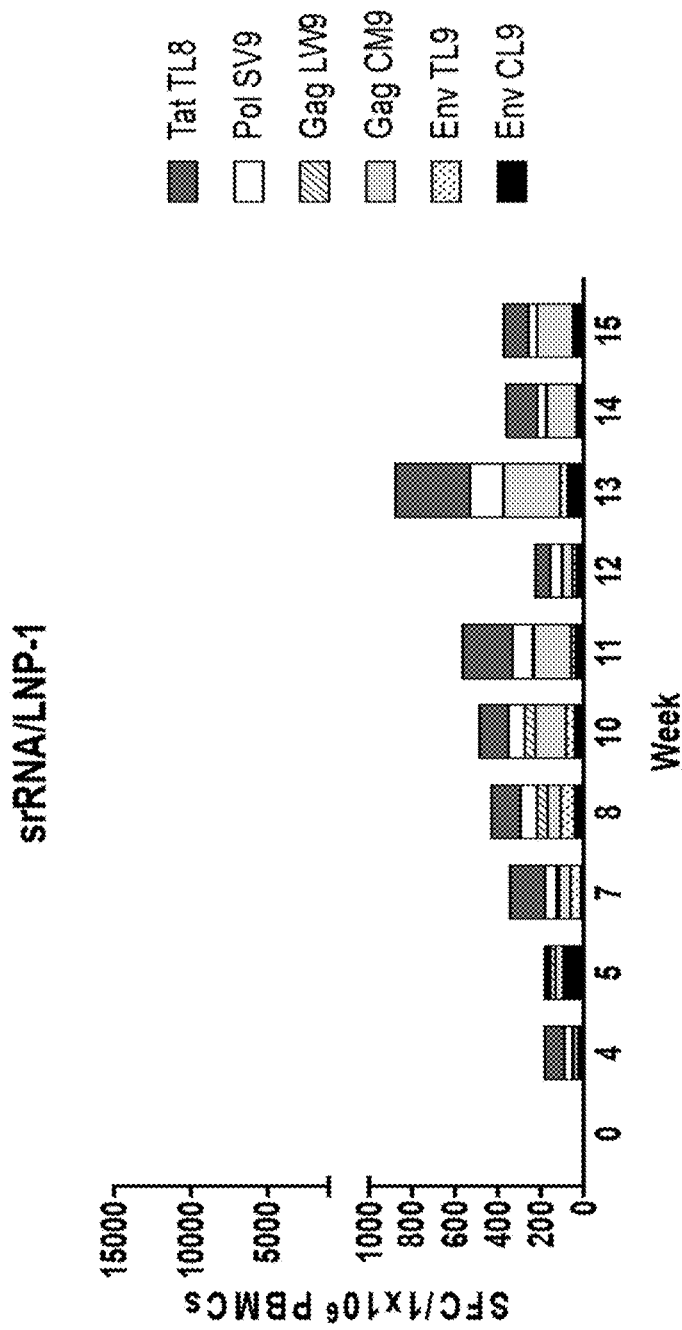
FIG. 23 shows antigen-specific cellular immune response measured using ELISpot. Antigen-specific IFN-gamma production to six different mamu A01 restricted epitopes was measured in PBMCs after immunization with the VEE-MAG25mer srRNA LNP1 homologous prime/boost regimen using ELISpot prior to immunization and 4, 5, 6, 7, 8, 10, 11, 12, 13, 14, or 15 weeks after the initial immunization. Results are presented as mean spot forming cells (SFC) per 10⁶ PBMCs for each epitope (6 rhesus macaques per group) in a stacked bar graph format.

Mamu-A*01 Indian rhesus macaques were also immunized with VEE-MAG25mer srRNA using two different LNP formulations (LNP1 and LNP2). Antigen-specific cellular immune responses in peripheral blood mononuclear cells (PBMCs) were measured to six different Mamu-A*01 restricted epitopes prior to immunization and 4, 5, 6, 7, 8, 10, 11, 12, 13, 14, or 15 weeks after the initial immunization (FIGS. 22 and 23, Tables 28 and 29). Animals received boost immunizations with VEE-MAG25mer srRNA using the respective LNP1 or LNP2 formulation on weeks 4 and 12. Combined antigen-specific immune responses of 168, 204, 103, 126, 140, 145, 330, 203, and 162 SFCs per 106 PBMCs (six epitopes combined) were measured 4, 5, 7, 8, 10, 11, 13, 14, 15 weeks after the immunization with VEE-MAG25mer srRNA-LNP2 (FIG. 22). Combined antigen-specific immune responses of 189, 185, 349, 437, 492, 570, 233, 886, 369, and 381 SFCs per $10^6$ PBMCs (six epitopes combined) were measured 4, 5, 7, 8, 10, 11, 12, 13, 14, 15 weeks after the immunization with VEE-MAG25mer srRNA-LNP1 (FIG. 23).

TABLE 27

Mean spot forming cells (SFC) per $10^6$ PBMCs for each epitope ± SEM for priming vaccination with ChAdV68.5WTnt.MAG25mer (Group 1)

| | Antigen | | | | | |
|---|---|---|---|---|---|---|
| Wk | Env CL9 | Env TL9 | Gag CM9 | Gag LW9 | Pol SV9 | Tat TL8 |
| 4 | 173 ± 41.6 | 373.5 ± 87.3 | 461.4 ± 74.2 | 38.4 ± 26.1 | 94.5 ± 26 | 609.2 ± 121.9 |
| 5 | 412.7 ± 138.4 | 987.8 ± 283.3 | 1064.4 ± 266.9 | 85.6 ± 31.2 | 367.2 ± 135.2 | 1306.8 ± 332.8 |
| 6 | 116.2 ± 41.2 | 231.1 ± 46.3 | 268.3 ± 90.7 | 86.1 ± 42 | 174.3 ± 61 | 223.9 ± 38.1 |
| 7 | 287.4 ± 148.7 | 588.9 ± 173.9 | 693.2 ± 224.8 | 92.1 ± 33.5 | 172.9 ± 55.6 | 694.6 ± 194.8 |
| 8 | 325.4 ± 126.6 | 735.8 ± 212 | 948.9 ± 274.5 | 211.3 ± 62.7 | 179.1 ± 50 | 817.3 ± 185.2 |
| 10 | 312 ± 129.7 | 543.2 ± 188.4 | 618.6 ± 221.7 | −5.7 ± 4.1 | 136.5 ± 51.3 | 309.9 ± 85.6 |
| 11 | 248.5 ± 81.1 | 348.7 ± 129.8 | 581.1 ± 205.5 | −3.1 ± 4.4 | 119 ± 51.2 | 413.7 ± 144.8 |
| 12 | 261.9 ± 68.2 | 329.9 ± 83 | 486.5 ± 118.6 | −1.2 ± 5.1 | 132.8 ± 31.8 | 350.9 ± 69.3 |
| 13 | 389.3 ± 167.7 | 1615.8 ± 418.3 | 1244.3 ± 403.6 | 1.3 ± 8.1 | 522.5 ± 155 | 1303.3 ± 385.6 |
| 14 | 406.3 ± 121.6 | 1616 ± 491.7 | 1142.3 ± 247.2 | 6.6 ± 11.1 | 322.7 ± 94.1 | 1048.6 ± 215.6 |
| 15 | 446.8 ± 138.7 | 1700.8 ± 469.1 | 1306.3 ± 294.4 | 43 ± 24.5 | 421.2 ± 87.9 | 1001.5 ± 236.4 |
| 16 | 686.8 ± 268.8 | 1979.5 ± 541.7 | 1616.8 ± 411.8 | 2.4 ± 7.8 | 381.9 ± 116.4 | 1152.8 ± 352.7 |
| 17 | 375.8 ± 109.3 | 1378.6 ± 561.2 | 773.1 ± 210.3 | −1.4 ± 4.3 | 177.6 ± 93.7 | 691.7 ± 245 |
| 18 | 255.9 ± 99.7 | 1538.4 ± 498.1 | 498.7 ± 152.3 | −5.3 ± 3.5 | 26.2 ± 13.4 | 413.9 ± 164.8 |
| 19 | 133 ± 62.6 | 955.9 ± 456.8 | 491.1 ± 121.8 | −5.7 ± 4.1 | 50.3 ± 25.4 | 371.2 ± 123.7 |
| 20 | 163.7 ± 55.8 | 641.7 ± 313.5 | 357.9 ± 91.1 | 2.6 ± 7.5 | 41.4 ± 24.2 | 257.8 ± 68.9 |
| 21 | 319.9 ± 160.5 | 2017.1 ± 419.9 | 1204.8 ± 335.2 | −3.7 ± 5.1 | 268.1 ± 109.6 | 924.1 ± 301 |
| 22 | 244.7 ± 105.6 | 1370.9 ± 563.5 | 780.3 ± 390 | −3.6 ± 5.1 | 118.2 ± 68.1 | 473.3 ± 249.3 |
| 23 | 176.7 ± 81.8 | 1263.7 ± 527.3 | 838.6 ± 367.9 | −5.7 ± 4.1 | 73.6 ± 49 | 480.9 ± 163.9 |
| 24 | 236.5 ± 92 | 1324.7 ± 589.3 | 879.7 ± 321 | −0.4 ± 5.7 | 104 ± 53.1 | 498 ± 135.8 |

TABLE 28

Mean spot forming cells (SFC) per $10^6$ PBMCs for each epitope ± SEM for priming vaccination with VEE-MAG25mer srRNA-LNP2 (300 µg) (Group 2)

| | Antigen | | | | | |
|---|---|---|---|---|---|---|
| Wk | Env CL9 | Env TL9 | Gag CM9 | Gag LW9 | Pol SV9 | Tat TL8 |
| 4 | 46 ± 27.1 | 18.4 ± 6.8 | 58.3 ± 45.8 | 29.9 ± 20.8 | 4.9 ± 2.3 | 10.7 ± 4 |
| 5 | 85.4 ± 54 | 5.2 ± 5.8 | 52.4 ± 51.2 | 34.5 ± 35 | 11.8 ± 12.2 | 14.4 ± 7.9 |
| 7 | 18.6 ± 32.5 | 1.9 ± 1.7 | 59.4 ± 55.7 | 9.3 ± 10.7 | 3.3 ± 3 | 10.7 ± 6.1 |
| 8 | 36.6 ± 39.4 | 6.3 ± 3.9 | 48.7 ± 39.9 | 13.5 ± 8.8 | 3.8 ± 3.6 | 17.2 ± 9.7 |
| 10 | 69.1 ± 59.1 | 4.4 ± 1.9 | 39.3 ± 38 | 14.7 ± 10.8 | 4.4 ± 5.3 | 8.5 ± 5.3 |
| 11 | 43 ± 38.8 | 22.6 ± 21.1 | 30.2 ± 26.2 | 3.3 ± 2.2 | 5.8 ± 3.5 | 40.3 ± 25.5 |
| 13 | 120.4 ± 78.3 | 68.2 ± 43.9 | 54.2 ± 36.8 | 21.8 ± 7.4 | 17.7 ± 6.1 | 47.4 ± 27.3 |
| 14 | 76 ± 44.8 | 28 ± 19.5 | 65.9 ± 64.3 | −0.3 ± 1.3 | 2.5 ± 2 | 31.1 ± 26.5 |
| 15 | 58.9 ± 41.4 | 19.5 ± 15.1 | 55.4 ± 51 | 2.5 ± 2 | 5.5 ± 3.6 | 20.1 ± 15.7 |

TABLE 29

Mean spot forming cells (SFC) per $10^6$ PBMCs for each epitope ± SEM for priming vaccination with VEE-MAG25mer srRNA-LNP1 (300 µg) (Group 3)

| | Antigen | | | | | |
|---|---|---|---|---|---|---|
| Wk | Env CL9 | Env TL9 | Gag CM9 | Gag LW9 | Pol SV9 | Tat TL8 |
| 4 | 19.5 ± 8.7 | 13.3 ± 13.1 | 16.5 ± 15.3 | 10.5 ± 7.3 | 35.9 ± 24.8 | 92.9 ± 91.6 |
| 5 | 87.9 ± 43.9 | 12.7 ± 11.7 | 37.2 ± 31.9 | 21.1 ± 23.8 | 13.2 ± 13.7 | 12.6 ± 13.7 |
| 7 | 21.1 ± 13.3 | 48.8 ± 48.4 | 51.7 ± 39.5 | 9.1 ± 10.5 | 58.6 ± 55.8 | 159.4 ± 159 |
| 8 | 47.7 ± 21.7 | 66.4 ± 52.2 | 59.8 ± 57.4 | 49.4 ± 28 | 79.4 ± 63 | 133.8 ± 132.1 |
| 10 | 49 ± 30.2 | 42.2 ± 41.1 | 139.3 ± 139.3 | 51.6 ± 51.2 | 78.2 ± 75.8 | 131.7 ± 131.6 |
| 11 | 42 ± 26.8 | 20.9 ± 21.4 | 177.1 ± 162 | −6.3 ± 4.3 | 104.3 ± 104.1 | 231.5 ± 230.1 |
| 12 | 40.2 ± 19 | 20.3 ± 11.9 | 42.2 ± 46.7 | 3.7 ± 6.7 | 57 ± 44.7 | 70 ± 69.2 |
| 13 | 81.2 ± 48.9 | 38.2 ± 37.6 | 259.4 ± 222.2 | −4 ± 4.1 | 164.1 ± 159.3 | 347.3 ± 343.5 |
| 14 | 34.5 ± 31.8 | 5.3 ± 11.6 | 138.6 ± 137.3 | −4.7 ± 5.2 | 52.3 ± 52.9 | 142.6 ± 142.6 |
| 15 | 49 ± 24 | 6.7 ± 9.8 | 167.1 ± 163.8 | −6.4 ± 4.2 | 47.8 ± 42.3 | 116.6 ± 114.5 | srRNA Dose Ranging Study

In one implementation of the present invention, an srRNA dose ranging study can be conducted in Mamu A01 Indian rhesus macaques to identify which srRNA dose to progress to NHP immunogenicity studies. In one example, Mamu A01 Indian rhesus macaques can be administered with an srRNA vector encoding model antigens that includes multiple Mamu A01 restricted epitopes by IM injection. In another example, an anti-CTLA-4 monoclonal antibody can be administered SC proximal to the site of IM vaccine injection to target the vaccine draining lymph node in one group of animals. PBMCs can be collected every 2 weeks after the initial vaccination for immune monitoring. The study arms are described in below (Table 30).

TABLE 30

Non-GLP RNA dose ranging study in Indian Rhesus Macaques

| Group | Prime | Boost 1 | Boost 2 |
|---|---|---|---|
| 1 | srRNA-LNP (Low Dose) | srRNA-LNP (Low Dose) | srRNA-LNP (Low Dose) |
| 2 | srRNA-LNP (Mid Dose) | srRNA-LNP (Mid Dose) | srRNA-LNP (Mid Dose) |
| 3 | srRNA-LNP (High Dose) | srRNA-LNP (High Dose) | srRNA-LNP (High Dose) |
| 4 | srRNA-LNP (High Dose) + anti-CTLA-4 | srRNA-LNP (High Dose) + anti-CTLA-4 | srRNA-LNP (High Dose) + anti-CTLA-4 |

* Dose range of srRNA to be determined with the high dose ≤300 □g.

Immunogenicity Study in Indian Rhesus Macaques

Figure 34:
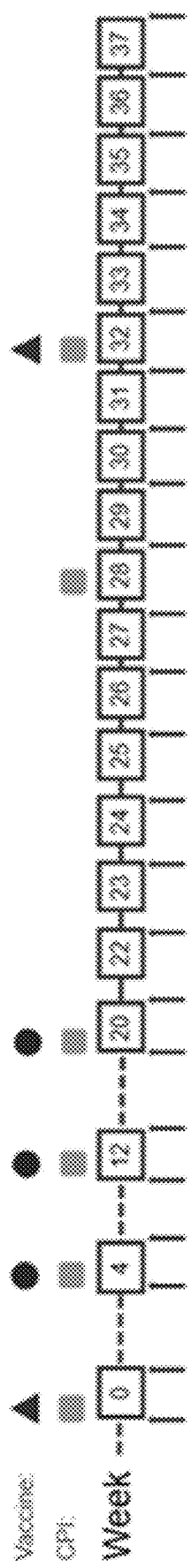
FIG. 34 illustrates the vaccination strategy used to evaluate immunogenicity of the antigen-cassette containing vectors in rhesus macaques. Triangles indicate ChAdV68 vaccination (1e12 vp/animal) at weeks 0 & 32. Circles represent alphavirus vaccination at weeks 0, 4, 12, 20, 28 & 32. Squares represent administration of an anti-CTLA4 antibody.

Vaccine studies were conducted in Mamu A01 Indian rhesus macaques (NHPs) to demonstrate immunogenicity using the antigen vectors. FIG. 34 illustrates the vaccination strategy. Three groups of NHPs were immunized with ChAdV68.5-WTnt.MAG25mer and either with the checkpoint inhibitor anti-CTLA-4 antibody Ipilimumab (Groups 5 & 6) or without the checkpoint inhibitor (Group 4). The antibody was administered either intra-venously (group 5) or subcutaneously (group 6). Triangles indicate ChAdV68 vaccination (1e12 vp/animal) at weeks 0 & 32. Circles represent alphavirus vaccination at weeks 0, 4, 12, 20, 28 and 32.

Figure 35:
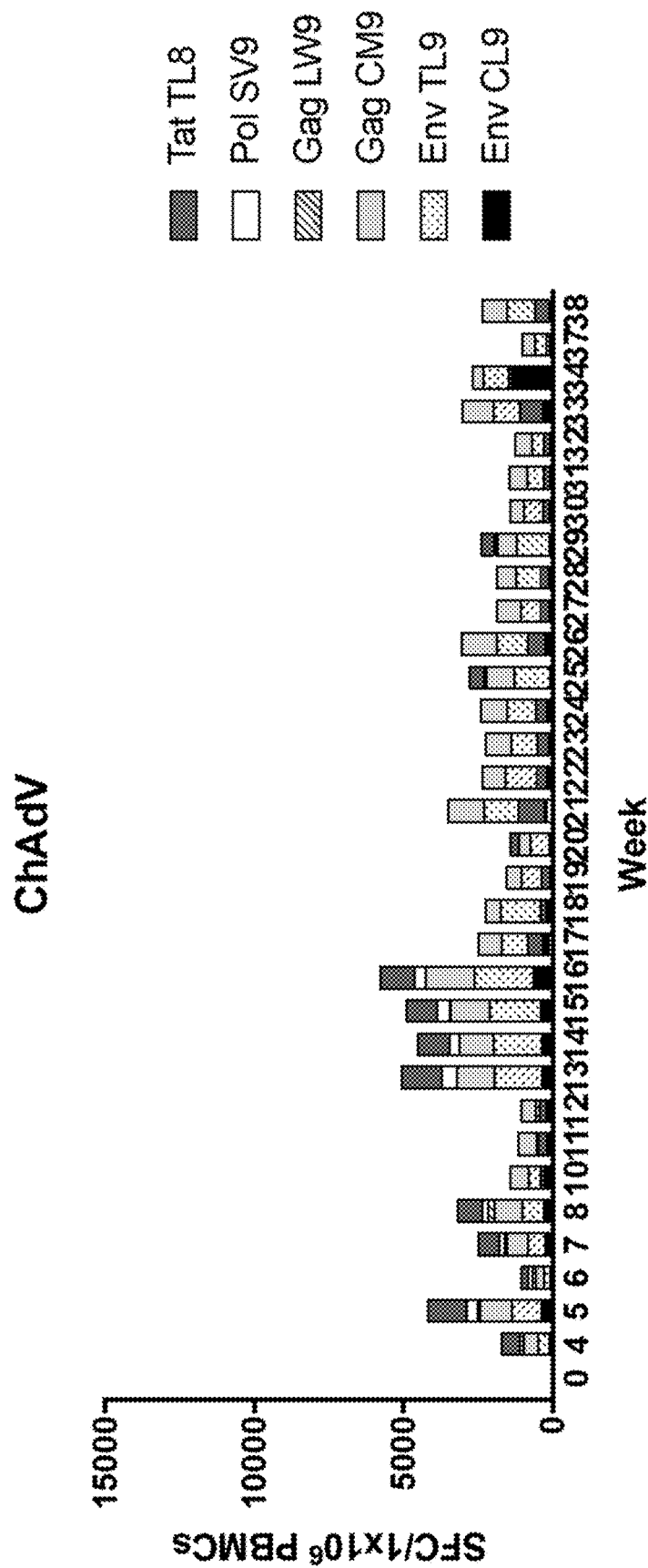
FIG. 35 shows a time course of CD8+ anti-epitope responses in Rhesus Macaques dosed with chAd-MAG alone (Group 4). Mean SFC/1e6 splenocytes is shown.
Figure 36:
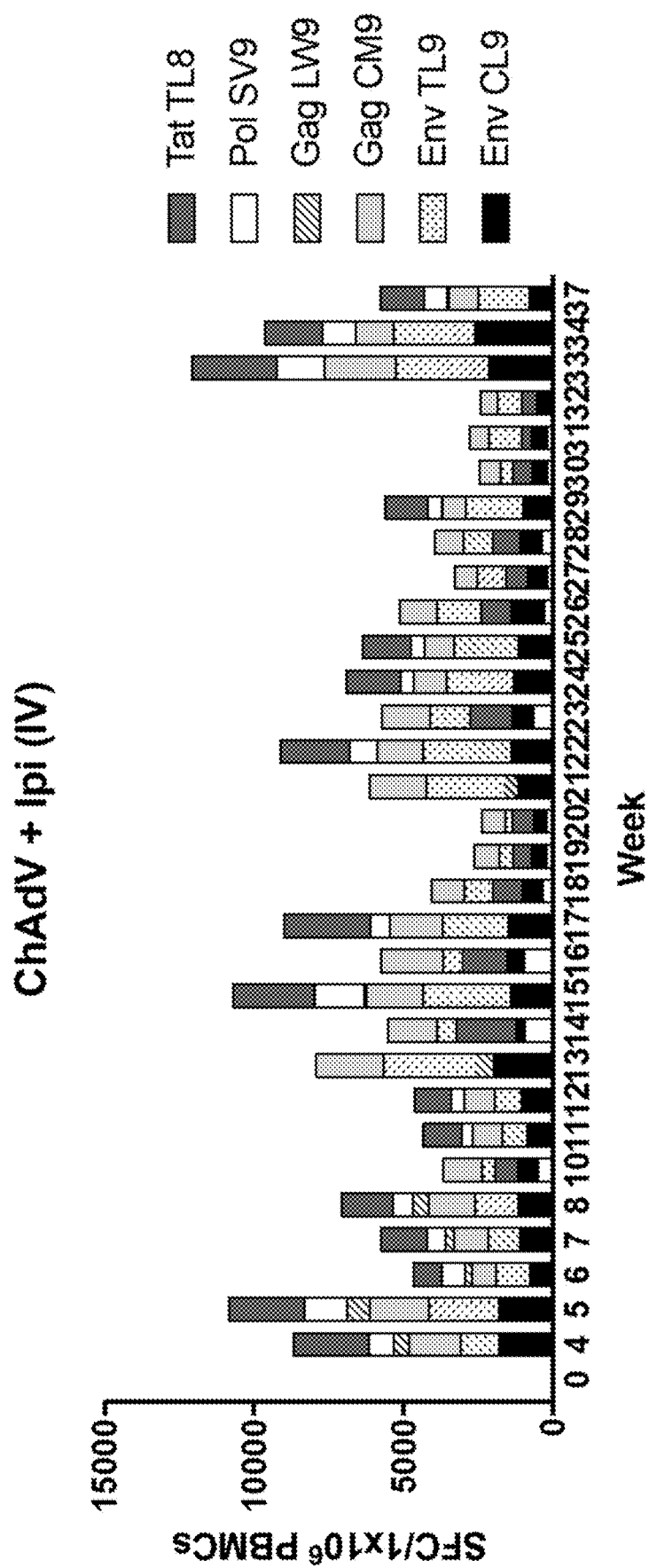
FIG. 36 shows a time course of CD8+ anti-epitope responses in Rhesus Macaques dosed with chAd-MAG plus anti-CTLA4 antibody (Ipilimumab) delivered IV (Group 5). Mean SFC/1e6 splenocytes is shown.
Figure 37:
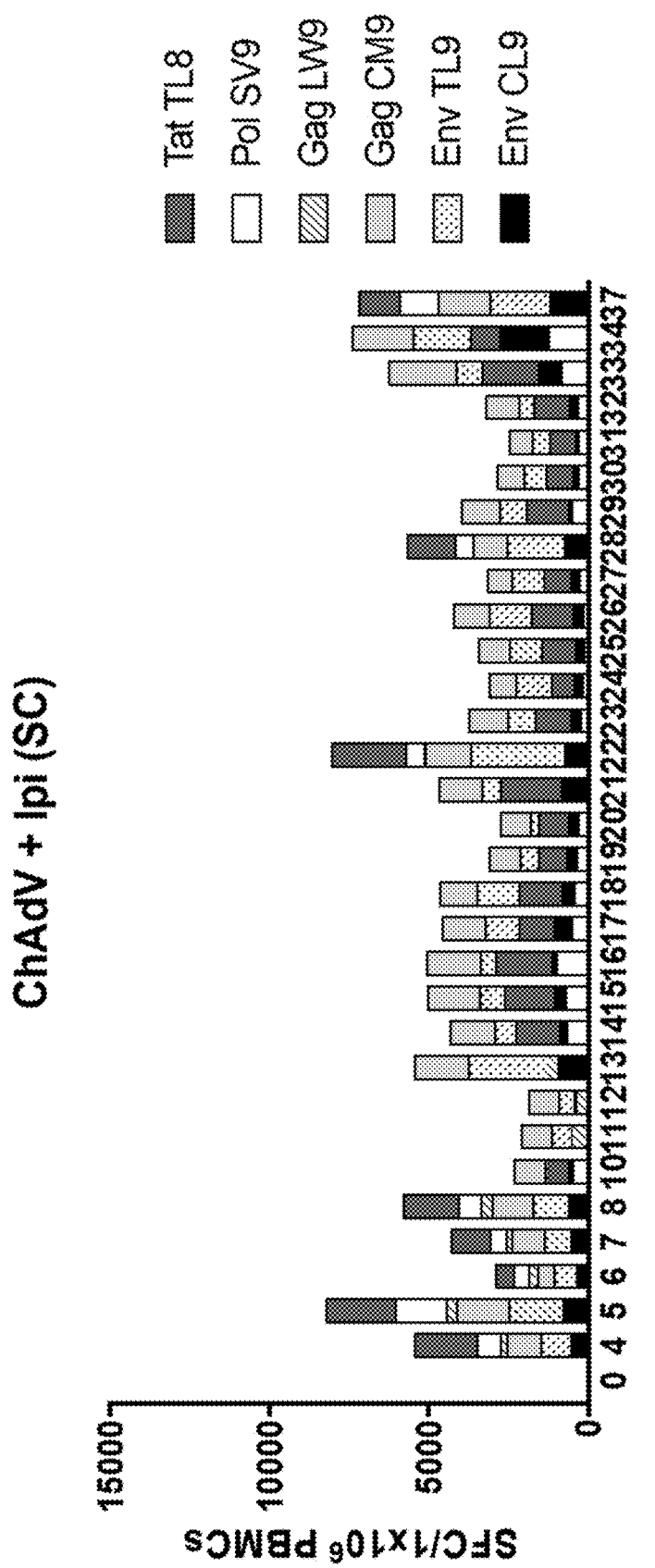
FIG. 37 shows a time course of CD8+ anti-epitope responses in Rhesus Macaques dosed with chAd-MAG plus anti-CTLA4 antibody (Ipilimumab) delivered SC (Group 6). Mean SFC/1e6 splenocytes is shown.

The time course of CD8+ anti-epitope responses in the immunized NHPs are presented for ChAdV-MAG immunization alone (FIG. 35 and Table 31A), ChAdV-MAG immunization with the checkpoint inhibitor delivered IV (FIG. 36 and Table 31B), and ChAdV-MAG immunization with the checkpoint inhibitor delivered SC (FIG. 37 and Table 31C). The results demonstrate ChAdV68 vectors efficiently primed CD8+ responses in primates, alphavirus vectors efficiently boosted the ChAdV68 vaccine priming response, checkpoint inhibitor whether delivered IV or SC amplified both priming and boosting responses, and ChAdV vectors readministered post vaccination to effectively boosted the immune responses.

TABLE 31A

CD8+ anti-epitope responses in Rhesus Macaques dosed with chAd-MAG (Group 4). Mean SFC/1e6 splenocytes +/− the standard error is shown

| | Antigen | | | | | |
|---|---|---|---|---|---|---|
| Wk | Env CL9 | Env TL9 | Gag CM9 | Gag LW9 | Pol SV9 | Tat TL8 |
| 4 | 173 ± 41.6 | 373.5 ± 87.3 | 461.4 ± 74.2 | 38.4 ± 26.1 | 94.5 ± 26 | 609.2 ± 121.9 |
| 5 | 412.7 ± 138.4 | 987.8 ± 283.3 | 1064.4 ± 266.9 | 85.6 ± 31.2 | 367.2 ± 135.2 | 1306.8 ± 332.8 |
| 6 | 116.2 ± 41.2 | 231.1 ± 46.3 | 268.3 ± 90.7 | 86.1 ± 42 | 174.3 ± 61 | 223.9 ± 38.1 |
| 7 | 287.4 ± 148.7 | 588.9 ± 173.9 | 693.2 ± 224.8 | 92.1 ± 33.5 | 172.9 ± 55.6 | 694.6 ± 194.8 |
| 8 | 325.4 ± 126.6 | 735.8 ± 212 | 948.9 ± 274.5 | 211.3 ± 62.7 | 179.1 ± 50 | 817.3 ± 185.2 |
| 10 | 312 ± 129.7 | 543.2 ± 188.4 | 618.6 ± 221.7 | −5.7 ± 4.1 | 136.5 ± 51.3 | 309.9 ± 85.6 |
| 11 | 248.5 ± 81.1 | 348.7 ± 129.8 | 581.1 ± 205.5 | −3.1 ± 4.4 | 119 ± 51.2 | 413.7 ± 144.8 |
| 12 | 261.9 ± 68.2 | 329.9 ± 83 | 486.5 ± 118.6 | −1.2 ± 5.1 | 132.8 ± 31.8 | 350.9 ± 69.3 |
| 13 | 389.3 ± 167.7 | 1615.8 ± 418.3 | 1244.3 ± 403.6 | 1.3 ± 8.1 | 522.5 ± 155 | 1303.3 ± 385.6 |
| 14 | 406.3 ± 121.6 | 1616 ± 491.7 | 1142.3 ± 247.2 | 6.6 ± 11.1 | 322.7 ± 94.1 | 1048.6 ± 215.6 |
| 15 | 446.8 ± 138.7 | 1700.8 ± 469.1 | 1306.3 ± 294.4 | 43 ± 24.5 | 421.2 ± 87.9 | 1001.5 ± 236.4 |
| 16 | 686.8 ± 268.8 | 1979.5 ± 541.7 | 1616.8 ± 411.8 | 2.4 ± 7.8 | 381.9 ± 116.4 | 1152.8 ± 352.7 |
| 17 | 375.8 ± 109.3 | 1378.6 ± 561.2 | 773.1 ± 210.3 | −1.4 ± 4.3 | 177.6 ± 93.7 | 691.7 ± 245 |
| 18 | 255.9 ± 99.7 | 1538.4 ± 498.1 | 498.7 ± 152.3 | −5.3 ± 3.3 | 26.2 ± 13.4 | 413.9 ± 164.8 |
| 19 | 133 ± 62.6 | 955.9 ± 456.8 | 491.1 ± 121.8 | −5.7 ± 4.1 | 50.3 ± 25.4 | 371.2 ± 123.7 |
| 20 | 163.7 ± 55.8 | 641.7 ± 313.5 | 357.9 ± 91.1 | 2.6 ± 7.5 | 41.4 ± 24.2 | 257.8 ± 68.9 |
| 21 | 319.9 ± 160.5 | 2017.1 ± 419.9 | 1204.8 ± 335.2 | −3.7 ± 5.1 | 268.1 ± 109.6 | 924.1 ± 301 |
| 22 | 244.7 ± 105.6 | 1370.9 ± 563.5 | 780.3 ± 390 | −3.6 ± 5.1 | 118.2 ± 68.1 | 473.3 ± 249.3 |
| 23 | 176.7 ± 81.8 | 1263.7 ± 527.3 | 838.6 ± 367.9 | −5.7 ± 4.1 | 73.6 ± 49 | 480.9 ± 163.9 |
| 24 | 236.5 ± 92 | 1324.7 ± 589.3 | 879.7 ± 321 | −0.4 ± 5.7 | 104 ± 53.1 | 498 ± 135.8 |
| 25 | 136.4 ± 52.6 | 1207.1 ± 501.6 | 924 ± 358.5 | 6.2 ± 10.5 | 74.1 ± 34.4 | 484.6 ± 116.7 |
| 26 | 278.2 ± 114.4 | 1645 ± 661.7 | 1170.2 ± 469.9 | −2.9 ± 5.7 | 80.6 ± 55.8 | 784.4 ± 214.1 |
| 27 | 159 ± 56.8 | 961.7 ± 547.1 | 783.6 ± 366.4 | −5 ± 4.3 | 63.6 ± 27.5 | 402.9 ± 123.4 |
| 28 | 189.6 ± 75.7 | 1073.1 ± 508.8 | 668.3 ± 312.5 | −5.7 ± 4.1 | 80.3 ± 38.3 | 386.4 ± 122 |
| 29 | 155.3 ± 69.1 | 1102.9 ± 606.1 | 632.9 ± 235 | 34.5 ± 24.2 | 80 ± 35.5 | 422.5 ± 122.9 |
| 30 | 160.2 ± 59.9 | 859 ± 440.9 | 455 ± 209.1 | −3 ± 5.3 | 60.5 ± 28.4 | 302.7 ± 123.2 |
| 31 | 122.2 ± 49.7 | 771.1 ± 392.7 | 582.2 ± 233.5 | −5.7 ± 4.1 | 55.1 ± 27.3 | 295.2 ± 68.3 |
| 32 | 119.3 ± 28.3 | 619.4 ± 189.7 | 566 ± 222.1 | −3.7 ± 5.1 | 21.9 ± 4.5 | 320.5 ± 76.4 |
| 33 | 380.5 ± 122 | 1636.1 ± 391.4 | 1056.2 ± 205.7 | −5.7 ± 4.1 | 154.5 ± 38.5 | 988.4 ± 287.7 |
| 34 | 1410.8 ± 505.4 | 972.4 ± 301.5 | 319.6 ± 89.6 | −4.8 ± 4.2 | 141.1 ± 49.8 | 1375.5 ± 296.7 |
| 37 | 130.8 ± 29.2 | 500 ± 156.9 | 424.9 ± 148.9 | −3.5 ± 4.7 | 77.7 ± 24.6 | 207.1 ± 42.4 |
| 38 | 167.7 ± 54.8 | 1390.8 ± 504.7 | 830.4 ± 329.1 | −5.5 ± 4.1 | 111.8 ± 43.2 | 516 ± 121.7 |

TABLE 31B

CD8+ anti-epitope responses in Rhesus Macaques dosed with ChAdV-MAG plus anti-CTLA4 antibody (Ipilimumab) delivered IV (Group 5). Mean SFC/1e6 splenocytes +/− the standard error is shown

| | Antigen | | | | | |
|---|---|---|---|---|---|---|
| Wk | Env CL9 | Env TL9 | Gag CM9 | Gag LW9 | Pol SV9 | Tat TL8 |
| 4 | 1848.1 ± 432.2 | 1295.7 ± 479.7 | 1709.8 ± 416.9 | 513.7 ± 219.8 | 838.5 ± 221.1 | 2514.6 ± 246.5 |
| 5 | 1844.1 ± 410.2 | 2367.5 ± 334.4 | 1983.1 ± 370.7 | 732.1 ± 249.4 | 1429.7 ± 275.3 | 2517.7 ± 286.5 |
| 6 | 822.4 ± 216.7 | 1131.2 ± 194.7 | 796.8 ± 185.8 | 226.8 ± 70 | 802.2 ± 101.4 | 913.5 ± 222.7 |
| 7 | 1147.2 ± 332.9 | 1066 ± 311.2 | 1149.8 ± 467.3 | 267.4 ± 162.6 | 621.5 ± 283.2 | 1552.2 ± 395.1 |
| 8 | 1192.7 ± 188.8 | 1461.5 ± 237.7 | 1566.9 ± 310.5 | 522.5 ± 118.6 | 662.3 ± 142.4 | 1706 ± 216.7 |
| 10 | 1249 ± 220.3 | 1170.6 ± 227.7 | 1297.3 ± 264.7 | −0.3 ± 4.4 | 551.8 ± 90.5 | 1425.3 ± 142.6 |
| 11 | 934.2 ± 221.7 | 808 ± 191.3 | 1003.1 ± 293.4 | 1.9 ± 4.3 | 364.2 ± 76.6 | 1270.8 ± 191.6 |
| 12 | 1106.2 ± 216.6 | 896.7 ± 190.7 | 1020.1 ± 243.3 | 1.3 ± 3.9 | 436.6 ± 90 | 1222 ± 155.4 |
| 13 | 2023.8 ± 556.3 | 3696.7 ± 1.7 | 2248.5 ± 436.4 | −4.5 ± 3.5 | 2614 ± 406.1 | 3700 ± 0 |
| 14 | 1278.7 ± 240 | 2639.5 ± 387 | 1654.6 ± 381.1 | −6 ± 2.1 | 988.8 ± 197.9 | 2288.3 ± 298.7 |
| 15 | 1458.9 ± 281.8 | 2932.5 ± 488.7 | 1893.4 ± 499 | 74.6 ± 15.6 | 1657.8 ± 508.9 | 2709.1 ± 428.7 |
| 16 | 1556.8 ± 243 | 2143.8 ± 295.2 | 2082.8 ± 234.2 | −5.8 ± 2.5 | 1014.6 ± 161.4 | 2063.7 ± 86.7 |
| 17 | 1527 ± 495.1 | 2213 ± 677.1 | 1767.7 ± 391.8 | 15.1 ± 5.9 | 633.8 ± 133.9 | 2890.8 ± 433.9 |
| 18 | 1068.2 ± 279.9 | 1940.9 ± 204.1 | 1114.1 ± 216.1 | −5.8 ± 2.5 | 396.6 ± 77.6 | 1659.4 ± 171.7 |
| 19 | 760.7 ± 362.2 | 1099.5 ± 438.4 | 802.7 ± 192.5 | −2.4 ± 3.3 | 262.2 ± 62.2 | 1118.6 ± 224.2 |
| 20 | 696.3 ± 138.2 | 954.9 ± 198 | 765.1 ± 248.4 | −1.4 ± 4.4 | 279.6 ± 89.3 | 1139 ± 204.5 |
| 21 | 1201.4 ± 327.9 | 3096 ± 1.9 | 1901 ± 412.1 | −5.8 ± 2.5 | 1676.3 ± 311.5 | 2809.3 ± 195.8 |
| 22 | 1442.5 ± 508.3 | 2944.7 ± 438.6 | 1528.4 ± 349.6 | 2.8 ± 5.1 | 940.7 ± 160.5 | 2318.3 ± 218.6 |
| 23 | 1400.4 ± 502.2 | 2757.1 ± 452.9 | 1604.2 ± 450.1 | −5.1 ± 2.3 | 708.1 ± 162.6 | 2100.4 ± 362.9 |
| 24 | 1351 ± 585.1 | 2264.5 ± 496 | 1080.6 ± 253.8 | 0.3 ± 6.5 | 444.2 ± 126.4 | 1823.7 ± 306.5 |
| 25 | 1211.5 ± 505.2 | 2160.4 ± 581.8 | 970.8 ± 235.9 | 2.5 ± 3.8 | 450.4 ± 126.9 | 1626.2 ± 261.3 |
| 26 | 1443 ± 492.5 | 2485 ± 588 | 1252.5 ± 326.4 | −0.2 ± 6 | 360.2 ± 92.3 | 2081.9 ± 331.1 |
| 27 | 896.2 ± 413.3 | 1686 ± 559.5 | 751 ± 192.1 | −3.7 ± 2.5 | 247.4 ± 82.8 | 1364.1 ± 232 |
| 28 | 1147.8 ± 456.9 | 1912.1 ± 417.1 | 930.3 ± 211.4 | −5.8 ± 2.5 | 423.9 ± 79.6 | 1649.3 ± 315 |
| 29 | 1038.5 ± 431.9 | 1915.2 ± 626.1 | 786.8 ± 205.9 | 23.5 ± 8.3 | 462.8 ± 64 | 1441.5 ± 249.7 |
| 30 | 730.5 ± 259.3 | 1078.6 ± 211.5 | 699.1 ± 156.2 | −4.4 ± 2.7 | 234.4 ± 43.9 | 1160.6 ± 112.6 |
| 31 | 750.4 ± 328.5 | 1431 ± 549.9 | 650.6 ± 141.1 | −5.2 ± 3 | 243.4 ± 56.4 | 868.9 ± 142.8 |
| 32 | 581.4 ± 227.7 | 1326.6 ± 505.2 | 573.3 ± 138 | −3.2 ± 4.2 | 160.8 ± 49.2 | 936.4 ± 110.4 |
| 33 | 2198.4 ± 403.8 | 3093.4 ± 123.3 | 2391.8 ± 378.4 | 7.1 ± 8.5 | 1598.1 ± 343.1 | 2827.5 ± 289.5 |
| 34 | 2654.3 ± 337 | 2709.9 ± 204.3 | 1297.5 ± 291.4 | 0.4 ± 4.2 | 1091.8 ± 242.9 | 1924 ± 245.7 |
| 37 | 846.8 ± 301.7 | 1706.9 ± 196 | 973.6 ± 149.3 | 50.5 ± 45.2 | 777.3 ± 140.2 | 1478.8 ± 94.3 |

TABLE 31C

CD8+ anti-epitope responses in Rhesus Macaques dosed with chAd-MAG plus anti-CTLA4 antibody (Ipilimumab) delivered SC (Group 6). Mean SFC/1e6 splenocytes +/− the standard error is shown

| | Antigen | | | | | |
|---|---|---|---|---|---|---|
| Wk | Env CL9 | Env TL9 | Gag CM9 | Gag LW9 | Pol SV9 | Tat TL8 |
| 4 | 598.3 ± 157.4 | 923.7 ± 306.8 | 1075.6 ± 171.8 | 180.5 ± 74.1 | 752.3 ± 245.8 | 1955.3 ± 444.4 |
| 5 | 842.2 ± 188.5 | 1703.7 ± 514.2 | 1595.8 ± 348.4 | 352.7 ± 92.3 | 1598.9 ± 416.8 | 2163.7 ± 522.1 |
| 6 | 396.4 ± 45.3 | 728.3 ± 232.7 | 503.8 ± 151.9 | 282 ± 69 | 463.1 ± 135.7 | 555.2 ± 191.5 |
| 7 | 584.2 ± 177 | 838.3 ± 254.9 | 1013.9 ± 349.4 | 173.6 ± 64.3 | 507.4 ± 165.7 | 1222.8 ± 368 |
| 8 | 642.9 ± 134 | 1128.6 ± 240.6 | 1259.1 ± 163.8 | 366.1 ± 72.8 | 726.7 ± 220.9 | 1695.6 ± 359.4 |
| 10 | 660.4 ± 211.4 | 746.9 ± 222.7 | 944.8 ± 210.2 | −1.2 ± 1.9 | 523.4 ± 230.7 | 787.3 ± 308.3 |
| 11 | 571.2 ± 162 | 609.4 ± 194.3 | 937.9 ± 186.5 | −8.9 ± 2.3 | 511.6 ± 229.6 | 1033.3 ± 315.7 |
| 12 | 485.3 ± 123.7 | 489.4 ± 142.7 | 919.3 ± 214.1 | −8.9 ± 2.3 | 341.6 ± 139.4 | 1394.7 ± 432.1 |
| 13 | 986.9 ± 154.5 | 2811.9 ± 411.3 | 1687.7 ± 344.3 | −4.1 ± 5.1 | 1368.5 ± 294.2 | 2751 ± 501.9 |
| 14 | 945.9 ± 251.4 | 2027.7 ± 492.8 | 1386.7 ± 326.7 | −5.7 ± 2.8 | 708.9 ± 277.1 | 1588.2 ± 440.1 |
| 15 | 1075.2 ± 322.4 | 2386 ± 580.7 | 1606.3 ± 368.1 | −5.4 ± 5.2 | 763.3 ± 248.8 | 1896.5 ± 507.8 |
| 16 | 1171.8 ± 341.6 | 2255.1 ± 439.6 | 1672.2 ± 342.3 | −7.8 ± 2.4 | 1031.6 ± 228.8 | 1896.4 ± 419.9 |
| 17 | 1118.2 ± 415.4 | 2156.3 ± 476 | 1345.3 ± 377.7 | −1.1 ± 6.7 | 573.7 ± 118.8 | 1614.4 ± 382.3 |
| 18 | 861.3 ± 313.8 | 2668.2 ± 366.8 | 1157.2 ± 259.6 | −8.9 ± 2.3 | 481.2 ± 164 | 1725.8 ± 511.4 |
| 19 | 719.2 ± 294.2 | 1447.2 ± 285 | 968 ± 294.5 | −2.2 ± 4.6 | 395.6 ± 106.1 | 1199.6 ± 289.2 |
| 20 | 651.6 ± 184 | 1189.8 ± 242.8 | 947.4 ± 249.8 | −8.9 ± 2.3 | 355 ± 106.3 | 1234.7 ± 361.7 |
| 21 | 810.3 ± 301.9 | 2576.2 ± 283.7 | 1334 ± 363.1 | −8.9 ± 2.3 | 892.2 ± 305 | 1904.4 ± 448.1 |
| 22 | 775 ± 196.4 | 2949 ± 409.7 | 1421.8 ± 309.7 | 38 ± 27.8 | 577 ± 144.2 | 2330.6 ± 572.3 |
| 23 | 584.9 ± 240.2 | 1977.9 ± 361.4 | 1209.8 ± 405.1 | −7.3 ± 3.2 | 273.7 ± 73.3 | 1430.6 ± 363.9 |
| 24 | 485.4 ± 194.4 | 1819.8 ± 325.5 | 837.2 ± 261.4 | −3.4 ± 4.1 | 234.4 ± 71.1 | 943.9 ± 243.3 |
| 25 | 452.3 ± 175 | 2072 ± 405.7 | 957.1 ± 293.1 | −8.9 ± 2.3 | 163 ± 43.2 | 1341.2 ± 394.7 |
| 26 | 517.9 ± 179.1 | 2616 ± 567.5 | 1126.6 ± 289 | −8.3 ± 2.3 | 199.9 ± 89.2 | 1615.7 ± 385.6 |
| 27 | 592.8 ± 171.7 | 1838.5 ± 372.4 | 749.3 ± 170.4 | −7.3 ± 2.5 | 325.5 ± 98.7 | 1110.7 ± 308.8 |
| 28 | 793 ± 228.5 | 1795.4 ± 332.3 | 1068.7 ± 210.3 | 2.5 ± 4.1 | 553.1 ± 144.3 | 1480.8 ± 357.1 |
| 29 | 661.8 ± 199.9 | 2140.6 ± 599.3 | 1202.7 ± 292.2 | −8.7 ± 2.8 | 558.9 ± 279.2 | 1424.2 ± 408.6 |
| 30 | 529.1 ± 163.3 | 1528.2 ± 249.8 | 840.5 ± 218.3 | −8.9 ± 2.3 | 357.7 ± 149.4 | 1029.3 ± 335 |
| 31 | 464.8 ± 152.9 | 1332.2 ± 322.7 | 726.3 ± 194.3 | −8.9 ± 2.3 | 354.3 ± 158.6 | 884.4 ± 282 |
| 32 | 612.9 ± 175.3 | 1584.2 ± 390.2 | 1058.3 ± 219.8 | −8.7 ± 2.8 | 364.6 ± 149.8 | 1388.8 ± 467.3 |

TABLE 31C-continued

CD8+ anti-epitope responses in Rhesus Macaques dosed with chAd-MAG plus anti-CTLA4 antibody (Ipilimumab) delivered SC (Group 6). Mean SFC/1e6 splenocytes +/- the standard error is shown

| | Antigen | | | | | |
|---|---|---|---|---|---|---|
| Wk | Env CL9 | Env TL9 | Gag CM9 | Gag LW9 | Pol SV9 | Tat TL8 |
| 33 | 1600.2 ± 416.7 | 2597.4 ± 367.9 | 2086.4 ± 414.8 | −6.3 ± 3.3 | 893.8 ± 266 | 2490.6 ± 416.4 |
| 34 | 2814.6 ± 376.2 | 2713.6 ± 380.8 | 1888.8 ± 499.4 | −7.5 ± 3.1 | 1288.9 ± 438.9 | 2428.1 ± 458.9 |
| 37 | 1245.9 ± 471.7 | 1877.7 ± 291.2 | 1606.6 ± 441.9 | 14.2 ± 13 | 1227.5 ± 348.1 | 1260.7 ± 342 |

Memory Phenotyping in Indian Rhesus Macaques

Figure 38:
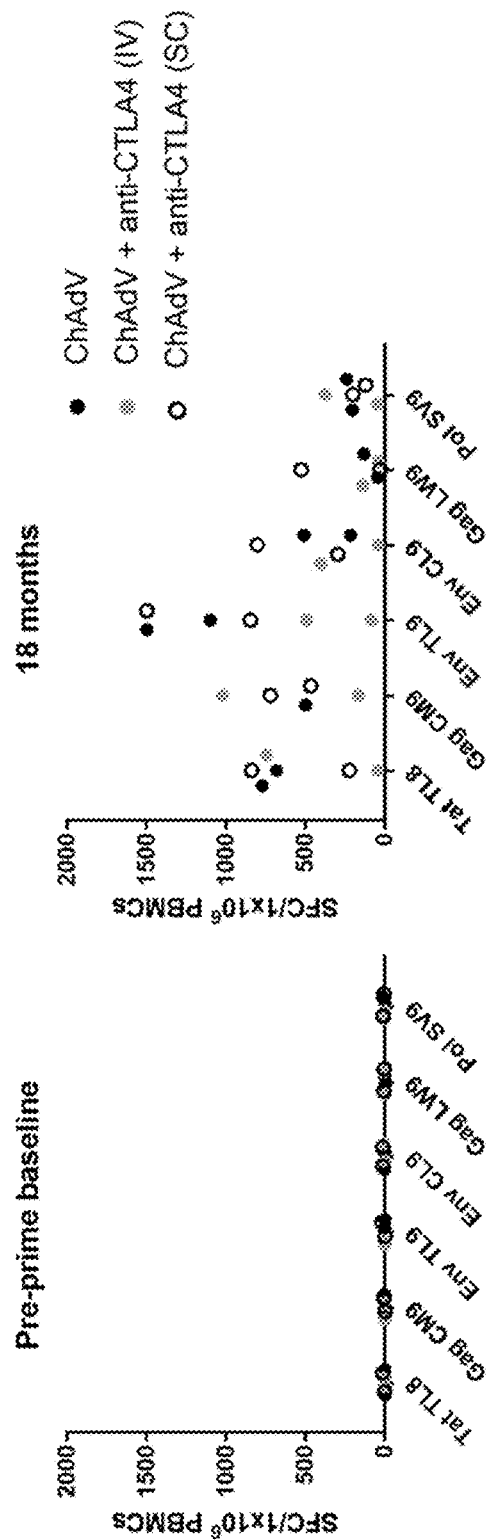
FIG. 38 shows antigen-specific memory responses generated by ChAdV68/samRNA vaccine protocol measured by ELISpot. Results are presented as individual dot plots, with each dot representing a single animal. Pre-immunization baseline (left panel) and memory response at 18 months post-prime (right panel) are shown.

Rhesus macaque were immunized with ChAdV68.5WTnt.MAG25mer/VEE-MAG25mer srRNA heterologous prime/boost regimen with or without anti-CTLA4, and boosted again with ChAdV68.5WTnt.MAG25mer. Groups were assessed 11 months after the final ChAdV68 administration (study month 18). by ELISpot was performed as described. FIG. 38 and Table 38 shows cellular responses to six different Mamu-A*01 restricted epitopes as measured by ELISpot both pre-immunization (left panel) and after 18 months (right panel). The detection of responses to the restricted epitopes demonstrates antigen-specific memory responses were generated by ChAdV68/samRNA vaccine protocol.

Figure 39:
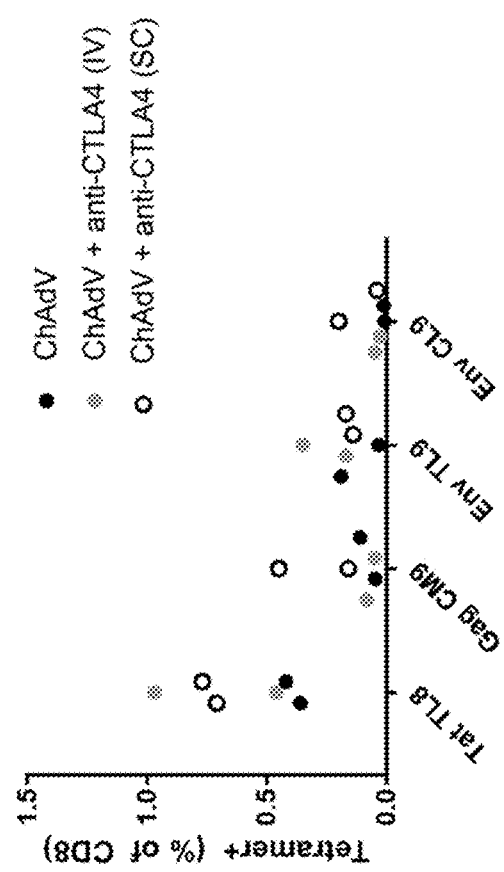
FIG. 39 shows memory cell phenotyping of antigen-specific CD8+ T-cells by flow cytometry using combinatorial tetramer staining and CD45RA/CCR7 co-staining.
Figure 40:
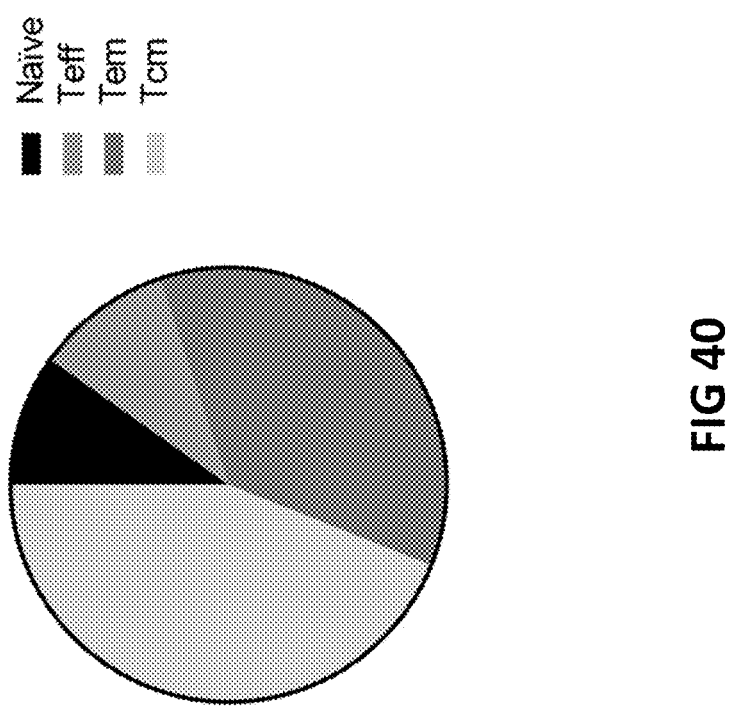
FIG. 40 shows the distribution of memory cell types within the sum of the four Mamu-A*01 tetramer+ CD8+ T-cell populations at study month 18. Memory cells were characterized as follows: CD45RA+CCR7+=naïve, CD45RA+CCR7-=effector (Teff), CD45RA-CCR7+=central memory (Tcm), CD45RA-CCR7-=effector memory (Tem).

To assess memory, CD8+ T-cells recognizing 4 different rhesus macaque Mamu-A*01 class I epitopes encoded in the vaccines were monitored using dual-color Mamu-A*01 tetramer labeling, with each antigen being represented by a unique double positive combination, and allowed the identification of all 4 antigen-specific populations within a single sample. Memory cell phenotyping was performed by co-staining with the cell surface markers CD45RA and CCR7. FIG. 39 and Table 39 shows the results of the combinatorial tetramer staining and CD45RA/CCR7 co-staining for memory T-cells recognizing four different Mamu-A*01 restricted epitopes. The T cell phenotypes were also assessed by flow cytometry. FIG. 40 shows the distribution of memory cell types within the sum of the four Mamu-A*01 tetramer+CD8+ T-cell populations at study month 18. Memory cells were characterized as follows: CD45RA+ CCR7+=naïve, CD45RA+CCR7-=effector (Teff), CD45RA-CCR7+=central memory (Tcm), CD45RA-CCR7-=effector memory (Tem). Collectively, the results demonstrate that memory responses were detected at least one year following the last boost indicating long lasting immunity, including effector, central memory, and effector memory populations.

TABLE 38

Mean spot forming cells (SFC) per $10^6$ PBMCs for each animal at both pre-prime and memory assessment time points (18 months).

| | Pre-prime baseline | | | | | | 18 months | | | | | |
|---|---|---|---|---|---|---|---|---|---|---|---|---|
| Animal | Tat TL8 | Gag CM9 | Env TL9 | Env CL9 | Gag LW9 | Pol SV9 | Tat TL8 | Gag CM9 | Env TL9 | Env CL9 | Gag LW9 | Pol SV9 |
| 1 | 1.7 | 0.0 | 0.0 | 5.0 | 0.0 | 13.7 | 683.0 | 499.2 | 1100.3 | 217.5 | 47.7 | 205.3 |
| 2 | 0.0 | 0.0 | 0.0 | 0.2 | 0.1 | 0.0 | 773.4 | ND | 1500.0 | 509.3 | 134.5 | 242.5 |
| 3 | 0.0 | 0.0 | 6.7 | 6.8 | 10.2 | 3.3 | 746.3 | 167.5 | 494.1 | 402.8 | 140.6 | 376.0 |
| 4 | 0.0 | 0.0 | 0.0 | 0.0 | 0.0 | 0.0 | 47.6 | 1023.9 | 85.1 | 44.2 | 44.2 | 47.6 |
| 5 | 15.3 | 6.7 | 18.6 | 15.6 | 5.2 | 12.1 | 842.4 | 467.7 | 1500.0 | 805.9 | 527.8 | 201.8 |
| 6 | 3.1 | 0.0 | 0.0 | 15.5 | 6.9 | 5.3 | 224.3 | 720.3 | 849.0 | 296.9 | 32.4 | 121.9 |

ND = not determined due to technical exclusion

TABLE 39

Percent Mamu-A*01 tetramer positive out of live CD8+ cells

| Animal | Tat 118 | Gag CM9 | Env 119 | Env CL9 |
|---|---|---|---|---|
| 1 | 0.42 | 0.11 | 0.19 | 0.013 |
| 2 | 0.36 | 0.048 | 0.033 | 0.00834 |
| 3 | 0.97 | 0.051 | 0.35 | 0.048 |
| 4 | 0.46 | 0.083 | 0.17 | 0.028 |
| 5 | 0.77 | 0.45 | 0.14 | 0.2 |
| 6 | 0.71 | 0.16 | 0.17 | 0.04 |

Non-GLP RNA Dose Ranging Study (Higher Doses) in Indian Rhesus Macaques

This study was designed to (a) evaluate the immunogenicity of VEE-MAG25mer srRNA at a dose of 300 μg as a homologous prime/boost or heterologous prime/boost in combination with ChAdV68.5WTnt.MAG25mer; (b) compare the immune responses of VEE-MAG25mer srRNA in lipid nanoparticles using LNP1 versus LNP2 at the 300 μg dose; and (c) evaluate the kinetics of T-cell responses to VEE-MAG25mer srRNA and ChAdV68.5WTnt.MAG25mer immunizations.

The study arm was conducted in Mamu-A*01 Indian rhesus macaques to demonstrate immunogenicity. Vaccine immunogenicity in nonhuman primate species, such as Rhesus, is the best predictor of vaccine potency in humans. Furthermore, select antigens used in this study are only recognized in Rhesus macaques, specifically those with a Mamu-A*01 MHC class I haplotype. Mamu-A*01 Indian rhesus macaques were randomized to the different study arms (6 macaques per group) and administered an IM injection bilaterally with either ChAdV68.5-WTnt.MAG25mer or VEE-MAG25mer srRNA encoding model antigens that includes multiple Mamu-A*01 restricted antigens. The study arms were as described below.

PBMCs were collected prior to immunization and 4, 5, 6, 7, 8, 10, 11, 12, 13, 14, 15, 16, 17, 18, 19, 20, 21, 22, 23 or 24 weeks after the initial immunization for immune monitoring for group 1 (heterologous prime/boost). PBMCs were collected prior to immunization and 4, 5, 7, 8, 10, 11, 12, 13, 14, or 15 weeks after the initial immunization for immune monitoring for groups 2 and 3 (homologous prime/boost).

TABLE 26

Non-GLP immunogenicity study in Indian Rhesus Macaques

| Group | Prime | Boost 1 | Boost 2 | Boost 3 |
|---|---|---|---|---|
| 1 | ChAdV68.5WTnt.MAG25mer | VEE-MAG25mer srRNA-LNP2 (300 μg) | VEE-MAG25mer srRNA-LNP2 (300 μg) | VEE-MAG25mer srRNA-LNP2 (300 μg) |
| 2 | VEE-MAG25mer srRNA-LNP2 (300 μg) | VEE-MAG25mer srRNA-LNP2 (300 μg) | VEE-MAG25mer srRNA-LNP2 (300 μg) | |
| 3 | VEE-MAG25mer srRNA-LNP1 (300 μg) | VEE-MAG25mer srRNA-LNP1 (300 μg) | VEE-MAG25mer srRNA-LNP1 (300 μg) | |

XIX. Identification of MHC/Peptide Target-Reactive T Cells and TCRs

Target reactive T cells and TCRs are identified for one or more of the antigen/HLA peptides pairs, including any antigens described herein, such as tumor-associated antigens or infectious disease associated antigens.

T cells can be isolated from blood, lymph nodes, or tumors of patients. T cells can be enriched for antigen-specific T cells, e.g., by sorting antigen-MHC tetramer binding cells or by sorting activated cells stimulated in an in vitro co-culture of T cells and antigen-pulsed antigen presenting cells. Various reagents are known in the art for antigen-specific T cell identification including antigen-loaded tetramers and other MHC-based reagents.

Antigen-relevant alpha-beta (or gamma-delta) TCR dimers can be identified by single cell sequencing of TCRs of antigen-specific T cells. Alternatively, bulk TCR sequencing of antigen-specific T cells can be performed and alpha-beta pairs with a high probability of matching can be determined using a TCR pairing method known in the art.

Alternatively or in addition, antigen-specific T cells can be obtained through in vitro priming of naïve T cells from healthy donors. T cells obtained from PBMCs, lymph nodes, or cord blood can be repeatedly stimulated by antigen-pulsed antigen presenting cells to prime differentiation of antigen-experienced T cells. TCRs can then be identified similarly as described above for antigen-specific T cells from patients.

XX. E4 Deletion in ChAdV68 Vectors Demonstrates Improved Productivity

Clones of a ChAdV68 adenoviral vector was selected for improved virus productivity. Fast growing/fit ChAdV68 viruses that express the model TSNA cassette MAG were selected for during plaque isolation and analyzed as described below.

Materials and Methods

ChAdV68 Plaque Isolation

Serial dilutions (from $10^{-2}$ to $10^{-9}$) of ChAdV68-MAG viruses were made and 100 uL plated on HEK293A (ThermoFisher cat. no. R70507) cells seeded at 1e6 cells/60 mM plate. 24 h post infection the media was removed and the infected cells were overlaid with DMEM/1.25% agarose and plaques were allowed to grow for 10-15 days. During this time, 72 viral plaques were picked. The virus was eluted overnight in 0.5 mL of DMEM/5% FBS media and half of the elution (0.25 mL) was used to re-infect 293A cells seeded at 1e5 cells/well of a 24 well plate. The viruses were amplified and infected onto 293A cells. Rapidly growing clones were selected for virus production in 400 mL 293F (ThermoFisher cat. No. A14528) suspension cultures. The virus was purified by 2×CsCl gradient purification and formulated into ARM buffer (25 mM NaCl, 20 mm Tris pH 8.0, 2.5% Glycerol) by 3 rounds of dialysis. Viral particle titers were determined by Absorbance at 260 nm measurement post 0.1% SDS lysis at 56 C. Infectious titers were determined using an anti-capsid immunostaining assay.

Next Generation Sequencing

DNA was purified from the purified virus using the QiAmp viral DNA kit (Qiagen) and subjected to NGS using the Illumina platform.

MOI Evaluation of Clone Productivity

Controlled infections were set up using the purified virus at an MOI of 0.1 IU and incubated for 96 h. Infectious units were measured in cell lysates. Production was compared to a non-plaque selected virus (pool).

Immunizations

Balb/c female mice were injected with 1×10⁹ or 1×10¹⁰ viral particles (VP) of ChAdV68.5WTnt.MAG25mer (SEQ ID NO:2) or ChAdV68-MAG-E4deleted (SEQ ID NO: 57; "MAG E4 Delta" and "ChAdV68-MAG-E4") in 100 uL volume, bilateral intramuscular injection (50 uL per leg).

Mamu-A*01 Indian rhesus macaques were immunized as bilateral intramuscular injections into the quadriceps muscle with 1×10¹² viral particles (5×10¹¹ viral particles per injection) of ChAdV68.5WTnt.MAG25mer ("ChAdV68-CMV-MAG"; SEQ ID NO:2; no E4 deletion or TET response element) or ChAdV68-E4d-CMT-MAG (SEQ ID NO:71; E4 deletion and CMT TET response element [see below]). Macaques were also administered 50 mg of an anti-CTLA4 antibody (Ipilimumab) SC on the day of injection.

```
ChAdV68-E4d-CMT-MAG; SEQ ID NO: 71
CATCATCAATAATATACCTCAAACTTTTTGTGCGCGTTAATATGCAAATGAGGCGTTTGAATTTGGGGAGGA

AGGGCGGTGATTGGTCGAGGGATGAGCGACCGTTAGGGGCGGGGCGAGTGACGTTTTGATGACGTGGTTG

CGAGGAGGAGCCAGTTTGCAAGTTCTCGTGGGAAAAGTGACGTCAAACGAGGTGTGGTTTGAACACGGAA

ATACTCAATTTTCCCGCGCTCTCTGACAGGAAATGAGGTGTTTCTGGGCGGATGCAAGTGAAAACGGGCCA

TTTTCGCGCGAAAACTGAATGAGGAAGTGAAAATCTGAGTAATTTCGCGTTTATGGCAGGGAGGAGTATTT

GCCGAGGGCCGAGTAGACTTTGACCGATTACGTGGGGGTTTCGATTACCGTGTTTTTCACCTAAATTTCCGC

GTACGGTGTCAAAGTCCGGTGTTTTTACGTAGGTGTCAGCTGATCGCCAGGGTATTTAAACCTGCGCTCTCC

AGTCAAGAGGCCACTCTTGAGTGCCAGCGAGAAGAGTTTTCTCCTCCGCGCCGCGAGTCAGATCTACACTT

TGAAAGTAGGGATAACAGGGTAATGACATTGATTATTGACTAGTTGTTAATAGTAATCAATTACGGGGTCA

TTAGTTCATAGCCCATATATGGAGTTCCGCGTTACATAACTTACGGTAAATGGCCCGCCTGGCTGACCGCCC

AACGACCCCCGCCCATTGACGTCAATAATGACGTATGTTCCCATAGTAACGCCAATAGGGACTTTCCATTG

ACGTCAATGGGTGGAGTATTTACGGTAAACTGCCCACTTGGCAGTACATCAAGTGTATCATATGCCAAGTC

CGCCCCCTATTGACGTCAATGACGGTAAATGGCCCGCCTGGCATTATGCCCAGTACATGACCTTACGGGAC

TTTCCTACTTGGCAGTACATCTACGTATTAGTCATCGCTATTACCATGGTGATGCGGTTTTGGCAGTACACC

AATGGGCGTGGATAGCGGTTTGACTCACGGGGATTTCCAAGTCTCCACCCCATTGACGTCAATGGGAGTTT

GTTTTGGCACCAAAATCAACGGGACTTTCCAAAATGTCGTAATAACCCCGCCCCGTTGACGCAAATGGGCG

GTAGGCGTGTACGGTGGGAGGTCTATATAAGCAGAGCTCTCCCTATCAGTGATAGAGATCTCCCTATCAGT

GATAGAGATCGTCGACGAGCTCGTTTAGTGAACCGTCAGATCGCCTGGAACGCCATCCACGCTGTTTTGAC

CTCCATAGAAGACAGCGATCGCGCCACCATGGCCGGGATGTTCCAGGCACTGTCCGAAGGCTGCACACCCT

ATGATATTAACCAGATGCTGAATGTCCTGGGAGACCACCAGGTCTCTGGCCTGGAGCAGCTGGAGAGCATC

ATCAACTTCGAGAAGCTGACCGAGTGGACAAGCTCCAATGTGATGCCTATCCTGTCCCCACTGACCAAGGG

CATCCTGGGCTTCGTGTTTACCCTGACAGTGCCTTCTGAGCGGGGCCTGTCTTGCATCAGCGAGGCAGACGC

AACCACACCAGAGTCCGCCAATCTGGGCGAGGAGATCCTGTCTCAGCTGTACCTGTGGCCCCGGGTGACAT

ATCACTCCCCTTCTTACGCCTATCACCAGTTCGAGCGGAGAGCCAAGTACAAGAGACACTTCCCAGGCTTT

GGCCAGTCTCTGCTGTTCGGCTACCCCGTGTACGTGTTCGGCGATTGCGTGCAGGGCGACTGGGATGCCATC

CGGTTTAGATACTGCGCACCACCTGGATATGCACTGCTGAGGTGTAACGACACCAATTATTCCGCCCTGCTG

GCAGTGGGCGCCCTGGAGGGCCCTCGCAATCAGGATTGGCTGGGCGTGCCAAGGCAGCTGGTGACACGCA

TGCAGGCCATCCAGAACGCAGGCCTGTGCACCCTGGTGGCAATGCTGGAGGAGACAATCTTCTGGCTGCAG

GCCTTTCTGATGGCCCTGACCGACAGCGGCCCCAAGACAAACATCATCGTGGATTCCCAGTACGTGATGGG

CATCTCCAAGCCTTCTTTCCAGGAGTTTGTGGACTGGGAGAACGTGAGCCCAGAGCTGAATTCCACCGATC

AGCCATTCTGGCAGGCAGGAATCCTGGCAAGGAACCTGGTGCCTATGGTGGCCACAGTGCAGGGCCAGAA

TCTGAAGTACCAGGGCCAGAGCCTGGTCATCAGCGCCTCCATCATCGTGTTTAACCTGCTGGAGCTGGAGG

GCGACTATCGGGACGATGGCAACGTGTGGGTGCACACCCCACTGAGCCCCAGAACACTGAACGCCTGGGT

GAAGGCCGTGGAGGAGAAGAAGGGCATCCCAGTGCACCTGGAGCTGGCCTCCATGACCAATATGGAGCTG

ATGTCTAGCATCGTGCACCAGCAGGTGAGGACATACGGACCCGTGTTCATGTGCCTGGGAGGCCTGCTGAC
```

```
CATGGTGGCAGGAGCCGTGTGGCTGACAGTGCGGGTGCTGGAGCTGTTCAGAGCCGCCCAGCTGGCCAAC

GATGTGGTGCTGCAGATCATGGAGCTGTGCGGAGCAGCCTTTCGCCAGGTGTGCCACACCACAGTGCCATG

GCCCAATGCCTCCCTGACCCCCAAGTGGAACAATGAGACAACACAGCCTCAGATCGCCAACTGTAGCGTGT

ACGACTTCTTCGTGTGGCTGCACTACTATAGCGTGAGGGATACCCTGTGGCCCCGCGTGACATACCACATG

AATAAGTACGCCTATCACATGCTGGAGAGGCGCGCCAAGTATAAGAGAGGCCCTGGCCCAGGCGCAAAGT

TTGTGGCAGCATGGACCCTGAAGGCCGCCGCCGGCCCCGGCCCCGGCCAGTATATCAAGGCTAACAGTAAG

TTCATTGGAATCACAGAGCTGGGACCCGGACCTGGATAATGAGTTTAAACTCCCATTTAAATGTGAGGGTT

AATGCTTCGAGCAGACATGATAAGATACATTGATGAGTTTGGACAAACCACAACTAGAATGCAGTGAAAA

AAATGCTTTATTTGTGAAATTTGTGATGCTATTGCTTTATTTGTAACCATTATAAGCTGCAATAAACAAGTT

AACAACAACAATTGCATTCATTTTATGTTTCAGGTTCAGGGGAGATGTGGGAGGTTTTTTAAAGCAAGTA

AAACCTCTACAAATGTGGTAAAATAACTATAACGGTCCTAAGGTAGCGAGTGAGTAGTGTTCTGGGCGGG

GGAGGACCTGCATGAGGGCCAGAATAACTGAAATCTGTGCTTTTCTGTGTGTTGCAGCAGCATGAGCGGAA

GCGGCTCCTTTGAGGGAGGGGTATTCAGCCCTTATCTGACGGGGCGTCTCCCCTCCTGGGCGGGAGTGCGT

CAGAATGTGATGGGATCCACGGTGGACGGCCGGCCCGTGCAGCCCGCGAACTCTTCAACCCTGACCTATGC

AACCCTGAGCTCTTCGTCGTTGGACGCAGCTGCCGCCGCAGCTGCTGCATCTGCCGCCAGCGCCGTGCGCG

GAATGGCCATGGGCGCCGGCTACTACGGCACTCTGGTGGCCAACTCGAGTTCCACCAATAATCCCGCCAGC

CTGAACGAGGAGAAGCTGTTGCTGCTGATGGCCCAGCTCGAGGCCTTGACCCAGCGCCTGGGCGAGCTGAC

CCAGCAGGTGGCTCAGCTGCAGGAGCAGACGCGGGCCGCGGTTGCCACGGTGAAATCCAAATAAAAAATG

AATCAATAAATAAACGGAGACGGTTGTTGATTTTAACACAGAGTCTGAATCTTTATTTGATTTTTCGCGCGC

GGTAGGCCCTGGACCACCGGTCTCGATCATTGAGCACCCGGTGGATCTTTTCCAGGACCCGGTAGAGGTGG

GCTTGGATGTTGAGGTACATGGGCATGAGCCCGTCCCGGGGGTGGAGGTAGCTCCATTGCAGGGCCTCGTG

CTCGGGGGTGGTGTTGTAAATCACCCAGTCATAGCAGGGGCGCAGGGCATGGTGTTGCACAATATCTTTGA

GGAGGAGACTGATGGCCACGGGCAGCCCTTTGGTGTAGGTGTTTACAAATCTGTTGAGCTGGGAGGGATGC

ATGCGGGGGAGATGAGGTGCATCTTGGCCTGGATCTTGAGATTGGCGATGTTACCGCCCAGATCCCGCCT

GGGGTTCATGTTGTGCAGGACCACCAGCACGGTGTATCCGGTGCACTTGGGGAATTTATCATGCAACTTGG

AAGGGAAGGCGTGAAAGAATTTGGCGACGCCTTTGTGCCCGCCCAGGTTTTCCATGCACTCATCCATGATG

ATGGCGATGGGCCCGTGGGCGGCGCCTGGGCAAAGACGTTTCGGGGGTCGGACACATCATAGTTGTGGTC

CTGGGTGAGGTCATCATAGGCCATTTTAATGAATTTGGGGCGGAGGGTGCCGGACTGGGGGACAAAGGTTC

CCTCGATCCCGGGGGCGTAGTTCCCCTCACAGATCTGCATCTCCCAGGCTTTGAGCTCGAGGGGGGGATC

ATGTCCACCTGCGGGGCGATAAAGAACACGGTTTCCGGGGCGGGGGAGATGAGCTGGGCCGAAAGCAAGT

TCCGGAGCAGCTGGGACTTGCCGCAGCCGGTGGGGCCGTAGATGACCCCGATGACCGGCTGCAGGTGGTA

GTTGAGGGAGAGACAGCTGCCGTCCTCCCGGAGGAGGGGGGCCACCTCGTTCATCATCTCGCGCACGTGCA

TGTTCTCGCGCACCAGTTCCGCCAGGAGGCGCTCTCCCCCCAGGGATAGGAGCTCCTGGAGCGAGGCGAAG

TTTTTCAGCGGCTTGAGTCCGTCGGCCATGGGCATTTTGGAGAGGGTTTGTTGCAAGAGTTCCAGGCGGTCC

CAGAGCTCGGTGATGTGCTCTACGGCATCTCGATCCAGCAGACCTCCTCGTTTCGCGGGTTGGGACGGCTG

CGGGAGTAGGGCACCAGACGATGGGCGTCCAGCGCAGCCAGGGTCCGGTCCTTCCAGGGTCGCAGCGTCC

GCGTCAGGGTGGTCTCCGTCACGGTGAAGGGGTGCGCGCCGGGCTGGGCGCTTGCGAGGGTGCGCTTCAGG

CTCATCCGGCTGGTCGAAAACCGCTCCCGATCGGCGCCCTGCGCGTCGGCCAGGTAGCAATTGACCATGAG

TTCGTAGTTGAGCGCCTCGGCCGCGTGGCCTTTGGCGCGAGCTTACCTTTGGAAGTCTGCCCGCAGGCGG

GACAGAGGAGGGACTTGAGGGCGTAGAGCTTGGGGGCGAGGAAGACGGACTCGGGGGCGTAGGCGTCCG
```

-continued
```
CGCCGCAGTGGGCGCAGACGGTCTCGCACTCCACGAGCCAGGTGAGGTCGGGCTGGTCGGGGTCAAAAAC
CAGTTTCCCGCCGTTCTTTTTGATGCGTTTCTTACCTTTGGTCTCCATGAGCTCGTGTCCCCGCTGGGTGACA
AAGAGGCTGTCCGTGTCCCCGTAGACCGACTTTATGGGCCGGTCCTCGAGCGGTGTGCCGCGGTCCTCCTC
GTAGAGGAACCCCGCCCACTCCGAGACGAAAGCCCGGGTCCAGGCCAGCACGAAGGAGGCCACGTGGGAC
GGGTAGCGGTCGTTGTCCACCAGCGGGTCCACCTTTTCCAGGGTATGCAAACACATGTCCCCCTCGTCCACA
TCCAGGAAGGTGATTGGCTTGTAAGTGTAGGCCACGTGACCGGGGGTCCCGGCCGGGGGGTATAAAAGG
GTGCGGGTCCCTGCTCGTCCTCACTGTCTTCCGGATCGCTGTCCAGGAGCGCCAGCTGTTGGGGTAGGTATT
CCCTCTCGAAGGCGGGCATGACCTCGGCACTCAGGTTGTCAGTTTCTAGAAACGAGGAGGATTTGATATTG
ACGGTGCCGGCGGAGATGCCTTTCAAGAGCCCCTCGTCCATCTGGTCAGAAAAGACGATCTTTTTGTTGTCG
AGCTTGGTGGCGAAGGAGCCGTAGAGGGCGTTGGAGAGGAGCTTGGCGATGGAGCGCATGGTCTGGTTTTT
TTCCTTGTCGGCGCGCTCCTTGGCGGCGATGTTGAGCTGCACGTACTCGCGCGCCACGCACTTCCATTCGGG
GAAGACGGTGGTCAGCTCGTCGGGCACGATTCTGACCTGCCAGCCCCGATTATGCAGGGTGATGAGGTCCA
CACTGGTGGCCACCTCGCCGCGCAGGGGCTCATTAGTCCAGCAGAGGCGTCCGCCCTTGCGCGAGCAGAAG
GGGGGCAGGGGGTCCAGCATGACCTCGTCGGGGGGGTCGGCATCGATGGTGAAGATGCCGGGCAGGAGGT
CGGGGTCAAAGTAGCTGATGGAAGTGGCCAGATCGTCCAGGGCAGCTTGCCATTCGCGCACGGCCAGCGC
GCGCTCGTAGGGACTGAGGGGCGTGCCCCAGGGCATGGATGGGTAAGCGCGGAGGCGTACATGCCGCAG
ATGTCGTAGACGTAGAGGGGCTCCTCGAGGATGCCGATGTAGGTGGGGTAGCAGCGCCCCCCGCGGATGCT
GGCGCGCACGTAGTCATACAGCTCGTGCGAGGGGCGAGGAGCCCCGGGCCCAGGTTGGTGCGACTGGGC
TTTTCGGCGCGGTAGACGATCTGGCGGAAAATGGCATGCGAGTTGGAGGAGATGGTGGGCCTTTGGAAGAT
GTTGAAGTGGGCGTGGGCAGTCCGACCGAGTCGCGGATGAAGTGGGCGTAGGAGTCTTGCAGCTTGGCG
ACGAGCTCGGCGGTGACTAGGACGTCCAGAGCGCAGTAGTCGAGGGTCTCCTGGATGATGTCATACTTGAG
CTGTCCCTTTTGTTTCCACAGCTCGCGGTTGAGAAGGAACTCTTCGCGGTCCTTCCAGTACTCTTCGAGGGG
GAACCCGTCCTGATCTGCACGGTAAGAGCCTAGCATGTAGAACTGGTTGACGGCCTTGTAGGCGCAGCAGC
CCTTCTCCACGGGGAGGGCGTAGGCCTGGGCGGCCTTGCGCAGGGAGGTGTGCGTGAGGGCGAAAGTGTC
CCTGACCATGACCTTGAGGAACTGGTGCTTGAAGTCGATATCGTCGCAGCCCCCCTGCTCCCAGAGCTGGA
AGTCCGTGCGCTTCTTGTAGGCGGGGTTGGGCAAAGCGAAAGTAACATCGTTGAAGAGGATCTTGCCCGCG
CGGGGCATAAAGTTGCGAGTGATGCGGAAAGGTTGGGGCACCTCGGCCCGGTTGTTGATGACCTGGGCGGC
GAGCACGATCTCGTCGAAGCCGTTGATGTTGTGGCCCACGATGTAGAGTTCCACGAATCGCGGACGGCCCT
TGACGTGGGCAGTTTCTTGAGCTCCTCGTAGGTGAGCTCGTCGGGGTCGCTGAGCCCGTGCTGCTCGAGC
GCCCAGTCGGCGAGATGGGGGTTGGCGCGGAGGAAGGAAGTCCAGAGATCCACGGCCAGGGCGGTTTGCA
GACGGTCCCGGTACTGACGGAACTGCTGCCCGACGGCCATTTTTTCGGGGGTGACGCAGTAGAAGGTGCGG
GGGTCCCCGTGCCAGCGATCCCATTTGAGCTGGAGGGCGAGATCGAGGGCGAGCTCGACGAGCCGGTCGT
CCCCGGAGAGTTTCATGACCAGCATGAAGGGGACGAGCTGCTTGCCGAAGGACCCCATCCAGGTGTAGGTT
TCCACATCGTAGGTGAGGAAGAGCCTTTCGGTGCGAGGATGCGAGCCGATGGGGAAGAACTGGATCTCCTG
CCACCAATTGGAGGAATGGCTGTTGATGTGATGGAAGTAGAAATGCCGACGGCGCGCCGAACACTCGTGCT
TGTGTTTATACAAGCGGCCACAGTGCTCGCAACGCTGCACGGGATGCACGTGCTGCACGAGCTGTACCTGA
GTTCCTTTGACGAGGAATTTCAGTGGGAAGTGGAGTCGTGGCGCCTGCATCTCGTGCTGTACTACGTCGTGG
TGGTCGGCCTGGCCCTCTTCTGCCTCGATGGTGGTCATGCTGACGAGCCCGCGCGGGAGGCAGGTCCAGAC
CTCGGCGCGAGCGGGTCGGAGAGCGAGGACGAGGGCGCGCAGGCCGGAGCTGTCCAGGGTCCTGAGACGC
TGCGGAGTCAGGTCAGTGGGCAGCGGCGGCGCGCGGTTGACTTGCAGGAGTTTTTCCAGGGCGCGCGGGA
GGTCCAGATGGTACTTGATCTCCACCGCGCCATTGGTGGCGACGTCGATGGCTTGCAGGGTCCCGTGCCCCT
```

-continued

```
GGGGTGTGACCACCGTCCCCGTTTCTTCTTGGGCGGCTGGGGCGACGGGGGCGGTGCCTCTTCCATGGTTA

GAAGCGGCGGCGAGGACGCGCGCCGGGCGGCAGGGGCGGCTCGGGGCCCGGAGGCAGGGGCGGCAGGGG

CACGTCGGCGCCGCGCGCGGGTAGGTTCTGGTACTGCGCCCGGAGAAGACTGGCGTGAGCGACGACGCGA

CGGTTGACGTCCTGGATCTGACGCCTCTGGGTGAAGGCCACGGGACCCGTGAGTTTGAACCTGAAAGAGAG

TTCGACAGAATCAATCTCGGTATCGTTGACGGCGGCCTGCCGCAGGATCTCTTGCACGTCGCCCGAGTTGTC

CTGGTAGGCGATCTCGGTCATGAACTGCTCGATCTCCTCCTCTTGAAGGTCTCCGCGGCCGGCGCGCTCCAC

GGTGGCCGCGAGGTCGTTGGAGATGCGGCCCATGAGCTGCGAGAAGGCGTTCATGCCCGCCTCGTTCCAGA

CGCGGCTGTAGACCACGACGCCCTCGGGATCGCGGGCGCGCATGACCACCTGGGCGAGGTTGAGCTCCAC

GTGGCGCGTGAAGACCGCGTAGTTGCAGAGGCGCTGGTAGAGGTAGTTGAGCGTGGTGGCGATGTGCTCG

GTGACGAAGAAATACATGATCCAGCGGCGGAGCGGCATCTCGCTGACGTCGCCCAGCGCCTCCAAACGTTC

CATGGCCTCGTAAAAGTCCACGGCGAAGTTGAAAAACTGGGAGTTGCGCGCCGAGACGGTCAACTCCTCCT

CCAGAAGACGGATGAGCTCGGCGATGGTGGCGCGCACCTCGCGCTCGAAGGCCCCCGGGAGTTCCTCCACT

TCCTCTTCTTCCTCCTCCACTAACATCTCTTCTACTTCCTCCTCAGGCGGCAGTGGTGGCGGGGAGGGGGC

CTGCGTCGCCGGCGGCGCACGGGCAGACGGTCGATGAAGCGCTCGATGGTCTCGCCGCGCCGGCGTCGCAT

GGTCTCGGTGACGGCGCGCCCGTCCTCGCGGGCCGCAGCGTGAAGACGCCGCCGCGCATCTCCAGGTGGC

CGGGGGGGTCCCCGTTGGGCAGGGAGAGGGCGCTGACGATGCATCTTATCAATTGCCCCGTAGGGACTCCG

CGCAAGGACCTGAGCGTCTCGAGATCCACGGGATCTGAAAACCGCTGAACGAAGGCTTCGAGCCAGTCGC

AGTCGCAAGGTAGGCTGAGCACGGTTTCTTCTGGCGGGTCATGTTGGTTGGGAGCGGGGCGGGCGATGCTG

CTGGTGATGAAGTTGAAATAGGCGGTTCTGAGACGGCGGATGGTGGCGAGGAGCACCAGGTCTTTGGGCCC

GGCTTGCTGGATGCGCAGACGGTCGGCCATGCCCCAGGCGTGGTCCTGACACCTGGCCAGGTCCTTGTAGT

AGTCCTGCATGAGCCGCTCCACGGGCACCTCCTCCTCGCCCGCGCGGCCGTGCATGCGCGTGAGCCCGAAG

CCGCGCTGGGGCTGGACGAGCGCCAGGTCGGCGACGACGCGCTCGGCGAGGATGGCTTGCTGGATCTGGG

TGAGGGTGGTCTGGAAGTCATCAAAGTCGACGAAGCGGTGGTAGGCTCCGGTGTTGATGGTGTAGGAGCA

GTTGGCCATGACGGACCAGTTGACGGTCTGGTGGCCCGGACGCACGAGCTCGTGGTACTTGAGGCGCGAGT

AGGCGCGCGTGTCGAAGATGTAGTCGTTGCAGGTGCGCACCAGGTACTGGTAGCCGATGAGGAAGTGCGG

CGGCGGCTGGCGGTAGAGCGGCCATCGCTCGGTGGCGGGGGCGCCGGGCGCGAGGTCCTCGAGCATGGTG

CGGTGGTAGCCGTAGATGTACCTGGACATCCAGGTGATGCCGGCGGCGGTGGTGGAGGCGCGCGGGAACT

CGCGGACGCGGTTCCAGATGTTGCGCAGCGGCAGGAAGTAGTTCATGGTGGGCACGGTCTGGCCCGTGAGG

CGCGCGCAGTCGTGGATGCTCTATACGGGCAAAAACGAAAGCGGTCAGCGGCTCGACTCCGTGGCCTGGA

GGCTAAGCGAACGGGTTGGGCTGCGCGTGTACCCCGGTTCGAATCTCGAATCAGGCTGGAGCCGCAGCTAA

CGTGGTATTGGCACTCCCGTCTCGACCCAAGCCTGCACCAACCCTCCAGGATACGGAGGCGGGTCGTTTTG

CAACTTTTTTTTGGAGGCCGGATGAGACTAGTAAGCGCGGAAAGCGGCCGACCGCGATGGCTCGCTGCCGT

AGTCTGGAGAAGAATCGCCAGGGTTGCGTTGCGGTGTGCCCCGGTTCGAGGCCGGCCGGATTCCGCGGCTA

ACGAGGGCGTGGCTGCCCCGTCGTTTCCAAGACCCCATAGCCAGCCGACTTCTCCAGTTACGGAGCGAGCC

CCTCTTTTGTTTTGTTTGTTTTGCCAGATGCATCCCGTACTGCGGCAGATGCGCCCCACCACCCTCCACCG

CAACAACAGCCCCCTCCACAGCCGGCGCTTCTGCCCCCGCCCCAGCAGCAACTTCCAGCCACGACCGCCGC

GGCCGCCGTGAGCGGGCTGGACAGAGTTATGATCACCAGCTGGCCTTGAAGAGGGCGAGGGGCTGGCG

CGCCTGGGGCGTCGTCGCCGGAGCGGCACCCGCGCGTGCAGATGAAAAGGGACGCTCGCGAGGCCTACG

TGCCCAAGCAGAACCTGTTCAGAGACAGGAGCGGCGAGGAGCCCGAGGAGATGCGCGCGGCCCGGTTCCA

CGCGGGGCGGGAGCTGCGGCGCGGCCTGGACCGAAAGAGGGTGCTGAGGGACGAGGATTTCGAGGCGGA
```

-continued

```
CGAGCTGACGGGGATCAGCCCCGCGCGCGCACGTGGCCGCGGCCAACCTGGTCACGGCGTACGAGCAG

ACCGTGAAGGAGGAGAGCAACTTCCAAAAATCCTTCAACAACCACGTGCGCACCCTGATCGCGCGCGAGG

AGGTGACCCTGGGCCTGATGCACCTGTGGGACCTGCTGGAGGCCATCGTGCAGAACCCCACCAGCAAGCCG

CTGACGGCGCAGCTGTTCCTGGTGGTGCAGCATAGTCGGGACAACGAAGCGTTCAGGGAGGCGCTGCTGAA

TATCACCGAGCCCGAGGGCCGCTGGCTCCTGGACCTGGTGAACATTCTGCAGAGCATCGTGGTGCAGGAGC

GCGGGCTGCCGCTGTCCGAGAAGCTGGCGGCCATCAACTTCTCGGTGCTGAGTTTGGGCAAGTACTACGCT

AGGAAGATCTACAAGACCCCGTACGTGCCCATAGACAAGGAGGTGAAGATCGACGGGTTTTACATGCGCA

TGACCCTGAAAGTGCTGACCCTGAGCGACGATCTGGGGGTGTACCGCAACGACAGGATGCACCGTGCGGT

GAGCGCCAGCAGGCGGCGCGAGCTGAGCGACCAGGAGCTGATGCATAGTCTGCAGCGGGCCCTGACCGGG

GCCGGGACCGAGGGGGAGAGCTACTTTGACATGGGCGCGGACCTGCACTGGCAGCCCAGCCGCCGGGCCT

TGGAGGCGGCGGCAGGACCCTACGTAGAAGAGGTGGACGATGAGGTGGACGAGGAGGGCGAGTACCTGG

AAGACTGATGGCGCGACCGTATTTTTGCTAGATGCAACAACAACAGCCACCTCCTGATCCCGCGATGCGGG

CGGCGCTGCAGAGCCAGCCGTCCGGCATTAACTCCTCGGACGATTGGACCCAGGCCATGCAACGCATCATG

GCGCTGACGACCCGCAACCCCGAAGCCTTTAGACAGCAGCCCCAGGCCAACCGGCTCTCGGCCATCCTGGA

GGCCGTGGTGCCCTCGCGCTCCAACCCCACGCACGAGAAGGTCCTGGCCATCGTGAACGCGCTGGTGGAGA

ACAAGGCCATCCGCGGCGACGAGGCCGGCCTGGTGTACAACGCGCTGCTGGAGCGCGTGGCCCGCTACAA

CAGCACCAACGTGCAGACCAACCTGGACCGCATGGTGACCGACGTGCGCGAGGCCGTGGCCCAGCGCGAG

CGGTTCCACCGCGAGTCCAACCTGGGATCCATGGTGGCGCTGAACGCCTTCCTCAGCACCCAGCCCGCCAA

CGTGCCCCGGGCCAGGAGGACTACACCAACTTCATCAGCGCCCTGCGCCTGATGGTGACCGAGGTGCCCC

AGAGCGAGGTGTACCAGTCCGGGCCGGACTACTTCTTCCAGACCAGTCGCCAGGGCTTGCAGACCGTGAAC

CTGAGCCAGGCTTTCAAGAACTTGCAGGGCCTGTGGGCGTGCAGGCCCCGGTCGGGGACCGCGCGACGG

TGTCGAGCCTGCTGACGCCGAACTCGCGCCTGCTGCTGCTGCTGGTGGCCCCCTTCACGGACAGCGGCAGC

ATCAACCGCAACTCGTACCTGGGCTACCTGATTAACCTGTACCGCGAGGCCATCGGCCAGGCGCACGTGGA

CGAGCAGACCTACCAGGAGATCACCCACGTGAGCCGCGCCCTGGGCCAGGACGACCCGGGCAACCTGGAA

GCCACCCTGAACTTTTTGCTGACCAACCGGTCGCAGAAGATCCCGCCCCAGTACGCGCTCAGCACCGAGGA

GGAGCGCATCCTGCGTTACGTGCAGCAGAGCGTGGGCCTGTTCCTGATGCAGGAGGGGGCCACCCCCAGCG

CCGCGCTCGACATGACCGCGCGCAACATGGAGCCCAGCATGTACGCCAGCAACCGCCCGTTCATCAATAAA

CTGATGGACTACTTGCATCGGGCGGCCGCCATGAACTCTGACTATTTCACCAACGCCATCCTGAATCCCCAC

TGGCTCCCGCCGCCGGGGTTCTACACGGGCGAGTACGACATGCCCGACCCCAATGACGGGTTCCTGTGGGA

CGATGTGGACAGCAGCGTGTTCTCCCCCCGACCGGGTGCTAACGAGCGCCCCTTGTGGAAGAAGGAAGGC

AGCGACCGACGCCCGTCCTCGGCGCTGTCCGGCCGCGAGGGTGCTGCCGCGGCGGTGCCCGAGGCCGCCA

GTCCTTTCCCGAGCTTGCCCTTCTCGCTGAACAGTATCCGCAGCAGCGAGCTGGGCAGGATCACGCGCCCG

CGCTTGCTGGGCGAAGAGGAGTACTTGAATGACTCGCTGTTGAGACCCGAGCGGGAGAAGAACTTCCCCAA

TAACGGGATAGAAAGCCTGGTGGACAAGATGAGCCGCTGGAAGACGTATGCGCAGGAGCACAGGGACGAT

CCCCGGGCGTCGCAGGGGGCCACGAGCCGGGGCAGCGCCGCCCGTAAACGCCGGTGGCACGACAGGCAGC

GGGGACAGATGTGGGACGATGAGGACTCCGCCGACGACAGCAGCGTGTTGGACTTGGGTGGGAGTGGTAA

CCCGTTCGCTCACCTGCGCCCCCGTATCGGGCGCATGATGTAAGAGAAACCGAAAATAAATGATACTCACC

AAGGCCATGGCGACCAGCGTGCGTTCGTTTCTTCTCTGTTGTTGTTGTATCTAGTATGATGAGGCGTGCGTA

CCCGGAGGGTCCTCCTCCCTCGTACGAGAGCGTGATGCAGCAGGCGATGGCGGCGGCGGCGATGCAGCCC

CCGCTGGAGGCTCCTTACGTGCCCCCGCGGTACCTGGCGCCTACGGAGGGGCGGAACAGCATTCGTTACTC

GGAGCTGGCACCCTTGTACGATACCACCCGGTTGTACCTGGTGGACAACAAGTCGGCGGACATCGCCTCGC
```

-continued

```
TGAACTACCAGAACGACCACAGCAACTTCCTGACCACCGTGGTGCAGAACAATGACTTCACCCCCACGGAG
GCCAGCACCCAGACCATCAACTTTGACGAGCGCTCGCGGTGGGGCGGCCAGCTGAAAACCATCATGCACA
CCAACATGCCCAACGTGAACGAGTTCATGTACAGCAACAAGTTCAAGGCGCGGGTGATGGTCTCCCGCAAG
ACCCCCAATGGGGTGACAGTGACAGAGGATTATGATGGTAGTCAGGATGAGCTGAAGTATGAATGGGTGG
AATTTGAGCTGCCCGAAGGCAACTTCTCGGTGACCATGACCATCGACCTGATGAACAACGCCATCATCGAC
AATTACTTGGCGGTGGGGCGGCAGAACGGGGTGCTGGAGAGCGACATCGGCGTGAAGTTCGACACTAGGA
ACTTCAGGCTGGGCTGGGACCCCGTGACCGAGCTGGTCATGCCCGGGGTGTACACCAACGAGGCTTTCCAT
CCCGATATTGTCTTGCTGCCCGGCTGCGGGGTGGACTTCACCGAGAGCCGCCTCAGCAACCTGCTGGGCAT
TCGCAAGAGGCAGCCCTTCCAGGAAGGCTTCCAGATCATGTACGAGGATCTGGAGGGGGCAACATCCCC
GCGCTCCTGGATGTCGACGCCTATGAGAAAAGCAAGGAGGATGCAGCAGCTGAAGCAACTGCAGCCGTAG
CTACCGCCTCTACCGAGGTCAGGGGCGATAATTTTGCAAGCGCCGCAGCAGTGGCAGCGGCCGAGGCGGCT
GAAACCGAAAGTAAGATAGTCATTCAGCCGGTGGAGAAGGATAGCAAGAACAGGAGCTACAACGTACTAC
CGGACAAGATAAACACCGCCTACCGCAGCTGGTACCTAGCCTACAACTATGGCGACCCCGAGAAGGGCGT
GCGCTCCTGGACGCTGCTCACCACCTCGGACGTCACCTGCGGCGTGGAGCAAGTCTACTGGTCGCTGCCCG
ACATGATGCAAGACCCGGTCACCTTCCGCTCCACGCGTCAAGTTAGCAACTACCCGGTGGTGGGCGCCGAG
CTCCTGCCCGTCTACTCCAAGAGCTTCTTCAACGAGCAGGCCGTCTACTCGCAGCAGCTGCGCGCCTTCACC
TCGCTTACGCACGTCTTCAACCGCTTCCCCGAGAACCAGATCCTCGTCCGCCCGCCCGCGCCCACCATTACC
ACCGTCAGTGAAAACGTTCCTGCTCTCACAGATCACGGGACCCTGCCGCTGCGCAGCAGTATCCGGGGAGT
CCAGCGCGTGACCGTTACTGACGCCAGACGCCGCACCTGCCCCTACGTCTACAAGGCCCTGGGCATAGTCG
CGCCGCGCGTCCTCTCGAGCCGCACCTTCTAAATGTCCATTCTCATCTCGCCCAGTAATAACACCGGTTGGG
GCCTGCGCGCGCCCAGCAAGATGTACGGAGGCGCTCGCCAACGCTCCACGCAACACCCCGTGCGCGTGCGC
GGGCACTTCCGCGCTCCCTGGGGCGCCCTCAAGGGCGCGTGCGGTCGCGCACCACCGTCGACGACGTGAT
CGACCAGGTGGTGGCCGACGCGCGCAACTACACCCCCGCCGCCGCGCCCGTCTCCACCGTGGACGCCGTCA
TCGACAGCGTGGTGGCCGACGCGCGCCGGTACGCCCGCGCCAAGAGCCGGCGGCGGCGCATCGCCCGGCG
GCACCGGAGCACCCCCGCCATGCGCGCGGCGCGAGCCTTGCTGCGCAGGGCCAGGCGCACGGGACGCAGG
GCCATGCTCAGGGCGGCCAGACGCGCGGCTTCAGGCGCCAGCGCCGGCAGGACCCGGAGACGCGCGGCCA
CGGCGGCGGCAGCGGCCATCGCCAGCATGTCCCGCCCGCGGCGAGGGAACGTGTACTGGGTGCGCGACGC
CGCCACCGGTGTGCGCGTGCCCGTGCGCACCCGCCCCCCTCGCACTTGAAGATGTTCACTTCGCGATGTTGA
TGTGTCCCAGCGGCGAGGAGGATGTCCAAGCGCAAATTCAAGGAAGAGATGCTCCAGGTCATCGCGCCTG
AGATCTACGGCCCTGCGGTGGTGAAGGAGGAAAGAAAGCCCCGCAAAATCAAGCGGGTCAAAAAGGACA
AAAAGGAAGAAGAAAGTGATGTGGACGGATTGGTGGAGTTTGTGCGCGAGTTCGCCCCCCGGCGGCGCGT
GCAGTGGCGCGGGCGGAAGGTGCAACCGGTGCTGAGACCCGGCACCACCGTGGTCTTCACGCCCGGCGAG
CGCTCCGGCACCGCTTCCAAGCGCTCCTACGACGAGGTGTACGGGGATGATGATATTCTGGAGCAGGCGGC
CGAGCGCCTGGGCGAGTTTGCTTACGGCAAGCGCAGCCGTTCCGCACCGAAGGAAGAGGCGGTGTCCATCC
CGCTGGACCACGGCAACCCCACGCCGAGCCTCAAGCCCGTGACCTTGCAGCAGGTGCTGCCGACCGCGGCG
CCGCGCCGGGGGTTCAAGCGCGAGGGCGAGGATCTGTACCCCACCATGCAGCTGATGGTGCCCAAGCGCC
AGAAGCTGGAAGACGTGCTGGAGACCATGAAGGTGGACCCGGACGTGCAGCCCGAGGTCAAGGTGCGGCC
CATCAAGCAGGTGGCCCCGGGCCTGGGCGTGCAGACCGTGGACATCAAGATTCCCACGGAGCCCATGGAA
ACGCAGACCGAGCCCATGATCAAGCCCAGCACCAGCACCATGGAGGTGCAGACGGATCCCTGGATGCCAT
CGGCTCCTAGTCGAAGACCCCGGCGCAAGTACGGCGCGGCCAGCCTGCTGATGCCCAACTACGCGCTGCAT
```

-continued

```
CCTTCCATCATCCCCACGCCGGGCTACCGCGGCACGCGCTTCTACCGCGGTCATACCAGCAGCCGCCGCCG

CAAGACCACCACTCGCCGCCGCCGTCGCCGCACCGCCGCTGCAACCACCCCTGCCGCCCTGGTGCGGAGAG

TGTACCGCCGCGGCCGCGCACCTCTGACCCTGCCGCGCGCGCGCTACCACCCGAGCATCGCCATTTAAACT

TTCGCCTGCTTTGCAGATCAATGGCCCTCACATGCCGCCTTCGCGTTCCCATTACGGGCTACCGAGGAAGAA

AACCGCGCCGTAGAAGGCTGGCGGGGAACGGGATGCGTCGCCACCACCACCGGCGGCGGCGCGCCATCAG

CAAGCGGTTGGGGGAGGCTTCCTGCCCGCGCTGATCCCCATCATCGCCGCGGCGATCGGGGCGATCCCCG

GCATTGCTTCCGTGGCGGTGCAGGCCTCTCAGCGCCACTGAGACACACTTGGAAACATCTTGTAATAAACC

AATGGACTCTGACGCTCCTGGTCCTGTGATGTGTTTTCGTAGACAGATGGAAGACATCAATTTTTCGTCCCT

GGCTCCGCGACACGGCACGCGGCCGTTCATGGGCACCTGGAGCGACATCGGCACCAGCCAACTGAACGGG

GGCGCCTTCAATTGGAGCAGTCTCTGGAGCGGGCTTAAGAATTTCGGGTCCACGCTTAAAACCTATGGCAG

CAAGGCGTGGAACAGCACCACAGGGCAGGCGCTGAGGGATAAGCTGAAAGAGCAGAACTTCCAGCAGAA

GGTGGTCGATGGGCTCGCCTCGGGCATCAACGGGGTGGTGGACCTGGCCAACCAGGCCGTGCAGCGGCAG

ATCAACAGCCGCCTGGACCCGGTGCCGCCCGCCGGCTCCGTGGAGATGCCGCAGGTGGAGGAGGAGCTGC

CTCCCCTGGACAAGCGGGGCGAGAAGCGACCCCGCCCCGATGCGGAGGAGACGCTGCTGACGCACACGGA

CGAGCCGCCCCCGTACGAGGAGGCGGTGAAACTGGGTCTGCCCACCACGCGGCCCATCGCGCCCCTGGCCA

CCGGGGTGCTGAAACCCGAAAAGCCCGCGACCCTGGACTTGCCTCCTCCCCAGCCTTCCCGCCCCTCTACA

GTGGCTAAGCCCCTGCCGCCGGTGGCCGTGGCCCGCGCGCGACCCGGGGCACCGCCCGCCCTCATGCGAA

CTGGCAGAGCACTCTGAACAGCATCGTGGGTCTGGGAGTGCAGAGTGTGAAGCGCCGCCGCTGCTATTAAA

CCTACCGTAGCGCTTAACTTGCTTGTCTGTGTGTATGTATTATGTCGCCGCCGCCGCTGTCCACCAGAAG

GAGGAGTGAAGAGGCGCGTCGCCGAGTTGCAAGATGGCCACCCCATCGATGCTGCCCCAGTGGGCGTACA

TGCACATCGCCGGACAGGACGCTTCGGAGTACCTGAGTCCGGGTCTGGTGCAGTTTGCCCGCGCCACAGAC

ACCTACTTCAGTCTGGGGAACAAGTTTAGGAACCCCACGGTGGCGCCCACGCACGATGTGACCACCGACCG

CAGCCAGCGGCTGACGCTGCGCTTCGTGCCCGTGGACCGCGAGGACAACACCTACTCGTACAAAGTGCGCT

ACACGCTGGCCGTGGGCGACAACCGCGTGCTGGACATGGCCAGCACCTACTTTGACATCCGCGGCGTGCTG

GATCGGGGCCCTAGCTTCAAACCCTACTCCGGCACCGCCTACAACAGTCTGGCCCCCAAGGGAGCACCCAA

CACTTGTCAGTGGACATATAAAGCCGATGGTGAAACTGCCACAGAAAAAACCTATACATATGGAAATGCAC

CCGTGCAGGGCATTAACATCACAAAAGATGGTATTCAACTTGGAACTGACACCGATGATCAGCCAATCTAC

GCAGATAAAACCTATCAGCCTGAACCTCAAGTGGGTGATGCTGAATGGCATGACATCACTGGTACTGATGA

AAAGTATGGAGGCAGAGCTCTTAAGCCTGATACCAAAATGAAGCCTTGTTATGGTTCTTTTGCCAAGCCTA

CTAATAAAGAAGGAGGTCAGGCAAATGTGAAAACAGGAACAGGCACTACTAAAGAATATGACATAGACAT

GGCTTTCTTTGACAACAGAAGTGCGGCTGCTGCTGGCCTAGCTCCAGAAATTGTTTTGTATACTGAAAATGT

GGATTTGGAAACTCCAGATACCCATATTGTATACAAAGCAGGCACAGATGACAGCAGCTCTTCTATTAATT

TGGGTCAGCAAGCCATGCCCAACAGACCTAACTACATTGGTTTCAGAGACAACTTTATCGGGCTCATGTAC

TACAACAGCACTGGCAATATGGGGGTGCTGGCCGGTCAGGCTTCTCAGCTGAATGCTGTGGTTGACTTGCA

AGACAGAAACACCGAGCTGTCCTACCAGCTCTTGCTTGACTCTCTGGGTGACAGAACCCGGTATTTCAGTAT

GTGGAATCAGGCGGTGGACAGCTATGATCCTGATGTGCGCATTATTGAAAATCATGGTGTGGAGGATGAAC

TTCCCAACTATTGTTTCCCTCTGGATGCTGTTGGCAGAACAGATACTTATCAGGGAATTAAGGCTAATGGAA

CTGATCAAACCACATGGACCAAAGATGACAGTGTCAATGATGCTAATGAGATAGGCAAGGGTAATCCATTC

GCCATGGAAATCAACATCCAAGCCAACCTGTGGAGGAACTTCCTCTACGCCAACGTGGCCCTGTACCTGCC

CGACTCTTACAAGTACACGCCGGCCAATGTTACCCTGCCCACCAACACCAACACCTACGATTACATGAACG

GCCGGGTGGTGGCGCCCTCGCTGGTGGACTCCTACATCAACATCGGGGCGCGCTGGTCGCTGGATCCCATG
```

-continued

```
GACAACGTGAACCCCTTCAACCACCACCGCAATGCGGGGCTGCGCTACCGCTCCATGCTCCTGGGCAACGG
GCGCTACGTGCCCTTCCACATCCAGGTGCCCCAGAAATTTTTCGCCATCAAGAGCCTCCTGCTCCTGCCCGG
GTCCTACACCTACGAGTGGAACTTCCGCAAGGACGTCAACATGATCCTGCAGAGCTCCCTCGGCAACGACC
TGCGCACGGACGGGGCCTCCATCTCCTTCACCAGCATCAACCTCTACGCCACCTTCTTCCCCATGGCGCACA
ACACGGCCTCCACGCTCGAGGCCATGCTGCGCAACGACACCAACGACCAGTCCTTCAACGACTACCTCTCG
GCGGCCAACATGCTCTACCCCATCCCGGCCAACGCCACCAACGTGCCCATCTCCATCCCCTCGCGCAACTG
GGCCGCCTTCCGCGGCTGGTCCTTCACGCGTCTCAAGACCAAGGAGACGCCCTCGCTGGGCTCCGGGTTCG
ACCCCTACTTCGTCTACTCGGGCTCCATCCCCTACCTCGACGGCACCTTCTACCTCAACCACACCTTCAAGA
AGGTCTCCATCACCTTCGACTCCTCCGTCAGCTGGCCCGGCAACGACCGGCTCCTGACGCCCAACGAGTTC
GAAATCAAGCGCACCGTCGACGGCGAGGGCTACAACGTGGCCCAGTGCAACATGACCAAGGACTGGTTCC
TGGTCCAGATGCTGGCCCACTACAACATCGGCTACCAGGGCTTCTACGTGCCCGAGGGCTACAAGGACCGC
ATGTACTCCTTCTTCCGCAACTTCCAGCCCATGAGCCGCCAGGTGGTGGACGAGGTCAACTACAAGGACTA
CCAGGCCGTCACCCTGGCCTACCAGCACAACAACTCGGGCTTCGTCGGCTACCTCGCGCCCACCATGCGCC
AGGGCCAGCCCTACCCCGCCAACTACCCCTACCCGCTCATCGGCAAGAGCGCCGTCACCAGCGTCACCCAG
AAAAAGTTCCTCTGCGACAGGGTCATGTGGCGCATCCCCTTCTCCAGCAACTTCATGTCCATGGGCGCGCTC
ACCGACCTCGGCCAGAACATGCTCTATGCCAACTCCGCCCACGCGCTAGACATGAATTTCGAAGTCGACCC
CATGGATGAGTCCACCCTTCTCTATGTTGTCTTCGAAGTCTTCGACGTCGTCCGAGTGCACCAGCCCCACCG
CGGCGTCATCGAGGCCGTCTACCTGCGCACCCCCTTCTCGGCCGGTAACGCCACCACCTAAGCTCTTGCTTC
TTGCAAGCCATGGCCGCGGGCTCCGGCGAGCAGGAGCTCAGGGCCATCATCCGCGACCTGGGCTGCGGGC
CCTACTTCCTGGGCACCTTCGATAAGCGCTTCCCGGGATTCATGGCCCCGCACAAGCTGGCCTGCGCCATCG
TCAACACGGCCGGCCGCGAGACCGGGGGCGAGCACTGGCTGGCCTTCGCCTGGAACCCGCGCTCGAACAC
CTGCTACCTCTTCGACCCCTTCGGGTTCTCGGACGAGCGCCTCAAGCAGATCTACCAGTTCGAGTACGAGG
GCCTGCTGCGCCGCAGCGCCCTGGCCACCGAGGACCGCTGCGTCACCCTGGAAAAGTCCACCCAGACCGTG
CAGGGTCCGCGCTCGGCCGCCTGCGGGCTCTTCTGCTGCATGTTCCTGCACGCCTTCGTGCACTGGCCCGAC
CGCCCCATGGACAAGAACCCCACCATGAACTTGCTGACGGGGGTGCCCAACGGCATGCTCCAGTCGCCCCA
GGTGGAACCCACCCTGCGCCGCAACCAGGAGGCGCTCTACCGCTTCCTCAACTCCCACTCCGCCTACTTTCG
CTCCCACCGCGCGCGCATCGAGAAGGCCACCGCCTTCGACCGCATGAATCAAGACATGTAAACCGTGTGTG
TATGTTAAATGTCTTTAATAAACAGCACTTTCATGTTACACATGCATCTGAGATGATTTATTTAGAAATCGA
AAGGGTTCTGCCGGGTCTCGGCATGGCCCGCGGGCAGGGACACGTTGCGGAACTGGTACTTGGCCAGCCAC
TTGAACTCGGGGATCAGCAGTTTGGGCAGCGGGGTGTCGGGGAAGGAGTCGGTCCACAGCTTCCGCGTCAG
TTGCAGGGCGCCCAGCAGGTCGGGCGCGGAGATCTTGAAATCGCAGTTGGGACCCGCGTTCTGCGCGCGGG
AGTTGCGGTACACGGGGTTGCAGCACTGGAACACCATCAGGGCCGGGTGCTTCACGCTCGCCAGCACCGTC
GCGTCGGTGATGCTCTCCACGTCGAGGTCCTCGGCGTTGGCCATCCCGAAGGGGGTCATCTTGCAGGTCTG
CCTTCCCATGGTGGGCACGCACCCGGGCTTGTGGTTGCAATCGCAGTGCAGGGGATCAGCATCATCTGGG
CCTGGTCGGCGTTCATCCCCGGGTACATGGCCTTCATGAAAGCCTCCAATTGCCTGAACGCCTGCTGGGCCT
TGGCTCCCTCGGTGAAGAAGACCCCGCAGGACTTGCTAGAGAACTGGTTGGTGGCGCACCCGGCGTCGTGC
ACGCAGCAGCGCGCGTCGTTGTTGGCCAGCTGCACCACGCTGCGCCCCCAGCGGTTCTGGGTGATCTTGGC
CCGGTCGGGGTTCTCCTTCAGCGCGCGCTGCCCGTTCTCGCTCGCCACATCCATCTCGATCATGTGCTCCTTC
TGGATCATGGTGGTCCCGTGCAGGCACCGCAGCTTGCCCTCGGCCTCGGTGCACCCGTGCAGCCACAGCGC
GCACCCGGTGCACTCCCAGTTCTTGTGGGCGATCTGGGAATGCGCGTGCACGAAGCCCTGCAGGAAGCGGC
```

-continued

```
CCATCATGGTGGTCAGGGTCTTGTTGCTAGTGAAGGTCAGCGGAATGCCGCGGTGCTCCTCGTTGATGTACA

GGTGGCAGATGCGGCGGTACACCTCGCCCTGCTCGGGCATCAGCTGGAAGTTGGCTTTCAGGTCGGTCTCC

ACGCGGTAGCGGTCCATCAGCATAGTCATGATTTCCATACCCTTCTCCCAGGCCGAGACGATGGGCAGGCT

CATAGGGTTCTTCACCATCATCTTAGCGCTAGCAGCCGCGGCCAGGGGTCGCTCTCGTCCAGGGTCTCAA

AGCTCCGCTTGCCGTCCTTCTCGGTGATCCGCACCGGGGGTAGCTGAAGCCCACGGCCGCCAGCTCCTCCT

CGGCCTGTCTTTCGTCCTCGCTGTCCTGGCTGACGTCCTGCAGGACCACATGCTTGGTCTTGCGGGGTTTCTT

CTTGGGCGGCAGCGGCGGCGGAGATGTTGGAGATGGCGAGGGGGAGCGCGAGTTCTCGCTCACCACTACT

ATCTCTTCCTCTTCTTGGTCCGAGGCCACGCGGCGGTAGGTATGTCTCTTCGGGGGCAGAGGCGGAGGCGA

CGGGCTCTCGCCGCCGCGACTTGGCGGATGGCTGGCAGAGCCCCTTCCGCGTTCGGGGGTGCGCTCCCGGC

GGCGCTCTGACTGACTTCCTCCGCGGCCGGCCATTGTGTTCTCCTAGGGAGGAACAACAAGCATGGAGACT

CAGCCATCGCCAACCTCGCCATCTGCCCCACCGCCGACGAGAAGCAGCAGCAGCAGAATGAAAGCTTAA

CCGCCCCGCCGCCCAGCCCCGCCACCTCCGACGCGGCCGTCCCAGACATGCAAGAGATGGAGGAATCCATC

GAGATTGACCTGGGCTATGTGACGCCCGCGGAGCACGAGGAGGAGCTGGCAGTGCGCTTTTCACAAGAAG

AGATACACCAAGAACAGCCAGAGCAGGAAGCAGAGAATGAGCAGAGTCAGGCTGGGCTCGAGCATGACG

GCGACTACCTCCACCTGAGCGGGGGGGAGGACGCGCTCATCAAGCATCTGGCCCGGCAGGCCACCATCGTC

AAGGATGCGCTGCTCGACCGCACCGAGGTGCCCCTCAGCGTGGAGGAGCTCAGCCGCGCCTACGAGTTGA

ACCTCTTCTCGCCGCGCGTGCCCCCCAAGCGCCAGCCCAATGGCACCTGCGAGCCCAACCCGCGCCTCAAC

TTCTACCCGGTCTTCGCGGTGCCCGAGGCCCTGGCCACCTACCACATCTTTTTCAAGAACCAAAAGATCCCC

GTCTCCTGCCGCGCCAACCGCACCCGCGCCGACGCCCTTTTCAACCTGGGTCCCGGCGCCCGCCTACCTGAT

ATCGCCTCCTTGGAAGAGGTTCCCAAGATCTTCGAGGGTCTGGGCAGCGACGAGACTCGGGCCGCGAACGC

TCTGCAAGGAGAAGGAGGAGAGCATGAGCACCACAGCGCCCTGGTCGAGTTGGAAGGCGACAACGCGCGG

CTGGCGGTGCTCAAACGCACGGTCGAGCTGACCCATTTCGCCTACCCGGCTCTGAACCTGCCCCCCAAAGT

CATGAGCGCGGTCATGGACCAGGTGCTCATCAAGCGCGCGTCGCCCATCTCCGAGGACGAGGGCATGCAA

GACTCCGAGGAGGGCAAGCCCGTGGTCAGCGACGAGCAGCTGGCCCGGTGGCTGGGTCCTAATGCTAGTC

CCCAGAGTTTGGAAGAGCGGCGCAAACTCATGATGGCCGTGGTCCTGGTGACCGTGGAGCTGGAGTGCCTG

CGCCGCTTCTTCGCCGACGCGGAGACCCTGCGCAAGGTCGAGGAGAACCTGCACTACCTCTTCAGGCACGG

GTTCGTGCGCCAGGCCTGCAAGATCTCCAACGTGGAGCTGACCAACCTGGTCTCCTACATGGGCATCTTGC

ACGAGAACCGCCTGGGGCAGAACGTGCTGCACACCACCCTGCGCGGGGAGGCCCGGCGCGACTACATCCG

CGACTGCGTCTACCTCTACCTCTGCCACACCTGGCAGACGGGCATGGGCGTGTGGCAGCAGTGTCTGGAGG

AGCAGAACCTGAAAGAGCTCTGCAAGCTCCTGCAGAAGAACCTCAAGGGTCTGTGGACCGGGTTCGACGA

GCGCACCACCGCCTCGGACCTGGCCGACCTCATTTTCCCCGAGCGCCTCAGGCTGACGCTGCGCAACGGCC

TGCCCGACTTTATGAGCCAAAGCATGTTGCAAAACTTTCGCTCTTTCATCCTCGAACGCTCCGGAATCCTGC

CCGCCACCTGCTCCGCGCTGCCCTCGGACTTCGTGCCGCTGACCTTCCGCGAGTGCCCCCCGCCGCTGTGGA

GCCACTGCTACCTGCTGCGCCTGGCCAACTACCTGGCCTACCACTCGGACGTGATCGAGGACGTCAGCGGC

GAGGGCCTGCTCGAGTGCCACTGCCGCTGCAACCTCTGCACGCCGCACCGCTCCCTGGCCTGCAACCCCCA

GCTGCTGAGCGAGACCCAGATCATCGGCACCTTCGAGTTGCAAGGGCCCAGCGAAGGCGAGGGTTCAGCC

GCCAAGGGGGGTCTGAAACTCACCCCGGGGCTGTGGACCTCGGCCTACTTGCGCAAGTTCGTGCCCGAGGA

CTACCATCCCTTCGAGATCAGGTTCTACGAGGACCAATCCCATCCGCCCAAGGCCGAGCTGTCGGCCTGCG

TCATCACCCAGGGGGCGATCCTGGCCCAATTGCAAGCCATCCAGAAATCCCGCCAAGAATTCTTGCTGAAA

AAGGGCCGCGGGGTCTACCTCGACCCCCAGACCGGTGAGGAGCTCAACCCCGGCTTCCCCCAGGATGCCCC

GAGGAAACAAGAAGCTGAAAGTGGAGCTGCCGCCCCGTGGAGGATTTGGAGGAAGACTGGGAGAACAGCA
```

-continued

```
GTCAGGCAGAGGAGGAGGAGATGGAGGAAGACTGGGACAGCACTCAGGCAGAGGAGGACAGCCTGCAAG

ACAGTCTGGAGGAAGACGAGGAGGAGGCAGAGGAGGAGGTGGAAGAAGCAGCCGCCGCCAGACCGTCGT

CCTCGGCGGGGGAGAAAGCAAGCAGCACGGATACCATCTCCGCTCCGGTCGGGGTCCCGCTCGACCACA

CAGTAGATGGGACGAGACCGGACGATTCCCGAACCCCACCACCCAGACCGGTAAGAAGGAGCGGCAGGGA

TACAAGTCCTGGCGGGGGCACAAAAACGCCATCGTCTCCTGCTTGCAGGCCTGCGGGGGCAACATCTCCTT

CACCCGGCGCTACCTGCTCTTCCACCGCGGGGTGAACTTTCCCCGCAACATCTTGCATTACTACCGTCACCT

CCACAGCCCCTACTACTTCCAAGAAGAGGCAGCAGCAGCAGAAAAAGACCAGCAGAAAACCAGCAGCTAG

AAAATCCACAGCGGCGGCAGCAGGTGGACTGAGGATCGCGGCGAACGAGCCGGCGCAAACCCGGGAGCT

GAGGAACCGGATCTTTCCCACCCTCTATGCCATCTTCCAGCAGAGTCGGGGGCAGGAGCAGGAACTGAAAG

TCAAGAACCGTTCTCTGCGCTCGCTCACCCGCAGTTGTCTGTATCACAAGAGCGAAGACCAACTTCAGCGC

ACTCTCGAGGACGCCGAGGCTCTCTTCAACAAGTACTGCGCGCTCACTCTTAAAGAGTAGCCCGCGCCCGC

CCAGTCGCAGAAAAAGGCGGGAATTACGTCACCTGTGCCCTTCGCCCTAGCCGCCTCCACCCATCATCATG

AGCAAAGAGATTCCCACGCCTTACATGTGGAGCTACCAGCCCCAGATGGGCCTGGCCGCCGGTGCCGCCCA

GGACTACTCCACCCGCATGAATTGGCTCAGCGCCGGGCCCGCGATGATCTCACGGGTGAATGACATCCGCG

CCCACCGAAACCAGATACTCCTAGAACAGTCAGCGCTCACCGCCACGCCCCGCAATCACCTCAATCCGCGT

AATTGGCCCGCCGCCCTGGTGTACCAGGAAATTCCCCAGCCCACGACCGTACTACTTCCGCGAGACGCCCA

GGCCGAAGTCCAGCTGACTAACTCAGGTGTCCAGCTGGCGGGCGGCGCCACCCTGTGTCGTCACCGCCCCG

CTCAGGGTATAAAGCGGCTGGTGATCCGGGGCAGAGGCACACAGCTCAACGACGAGGTGGTGAGCTCTTC

GCTGGGTCTGCGACCTGACGGAGTCTTCCAACTCGCCGGATCGGGGAGATCTTCCTTCACGCCTCGTCAGG

CCGTCCTGACTTTGGAGAGTTCGTCCTCGCAGCCCCGCTCGGGTGGCATCGGCACTCTCCAGTTCGTGGAGG

AGTTCACTCCCTCGGTCTACTTCAACCCCTTCTCCGGCTCCCCCGGCCACTACCCGGACGAGTTCATCCCGA

ACTTCGACGCCATCAGCGAGTCGGTGGACGGCTACGATTGAAACTAATCACCCCCTTATCCAGTGAAATAA

AGATCATATTGATGATGATTTTACAGAAATAAAAAATAATCATTTGATTTGAAATAAAGATACAATCATAT

TGATGATTTGAGTTTAACAAAAAAATAAAGAATCACTTACTTGAAATCTGATACCAGGTCTCTGTCCATGTT

TTCTGCCAACACCACTTCACTCCCCTCTTCCCAGCTCTGGTACTGCAGGCCCCGGCGGGCTGCAAACTTCCT

CCACACGCTGAAGGGGATGTCAAATTCCTCCTGTCCCTCAATCTTCATTTTATCTTCTATCAGATGTCCAAA

AAGCGCGTCCGGGTGGATGATGACTTCGACCCCGTCTACCCCTACGATGCAGACAACGCACCGACCGTGCC

CTTCATCAACCCCCCCTTCGTCTCTTCAGATGGATTCCAAGAGAAGCCCCTGGGGGTGTTGTCCCTGCGACT

GGCCGACCCCGTCACCACCAAGAACGGGGAAATCACCCTCAAGCTGGGAGAGGGGTGGACCTCGATTCC

TCGGGAAAACTCATCTCCAACACGGCCACCAAGGCCGCCGCCCCTCTCAGTTTTTCCAACAACACCATTTCC

CTTAACATGGATCACCCCTTTTACACTAAAGATGGAAAATTATCCTTACAAGTTTCTCCACCATTAAATATA

CTGAGAACAAGCATTCTAAACACACTAGCTTTAGGTTTTGGATCAGGTTTAGGACTCCGTGGCTCTGCCTTG

GCAGTACAGTTAGTCTCTCCACTTACATTTGATACTGATGGAAACATAAAGCTTACCTTAGACAGAGGTTTG

CATGTTACAACAGGAGATGCAATTGAAAGCAACATAAGCTGGGCTAAAGGTTTAAAATTTGAAGATGGAG

CCATAGCAACCAACATTGGAAATGGGTTAGAGTTTGGAAGCAGTAGTACAGAAACAGGTGTTGATGATGCT

TACCCAATCCAAGTTAAACTTGGATCTGGCCTTAGCTTTGACAGTACAGGAGCCATAATGGCTGGTAACAA

AGAAGACGATAAACTCACTTTGTGGACAACACCTGATCCATCACCAAACTGTCAAATACTCGCAGAAAATG

ATGCAAAACTAACACTTTGCTTGACTAAATGTGGTAGTCAAATACTGGCCACTGTGTCAGTCTTAGTTGTAG

GAAGTGGAAACCTAAACCCCATTACTGGCACCGTAAGCAGTGCTCAGGTGTTTCTACGTTTTGATGCAAAC

GGTGTTCTTTTAACAGAACATTCTACACTAAAAAAATACTGGGGGTATAGGCAGGGAGATAGCATAGATGG
```

-continued

```
CACTCCATATACCAATGCTGTAGGATTCATGCCCAATTTAAAAGCTTATCCAAAGTCACAAAGTTCTACTAC

TAAAAATAATATAGTAGGGCAAGTATACATGAATGGAGATGTTTCAAAACCTATGCTTCTCACTATAACCC

TCAATGGTACTGATGACAGCAACAGTACATATTCAATGTCATTTTCATACACCTGGACTAATGGAAGCTATG

TTGGAGCAACATTTGGGGCTAACTCTTATACCTTCTCATACATCGCCCAAGAATGAACACTGTATCCCACCC

TGCATGCCAACCCTTCCCACCCCACTCTGTGGAACAAACTCTGAAACACAAAATAAAATAAAGTTCAAGTG

TTTTATTGATTCAACAGTTTTACAGGATTCGAGCAGTTATTTTTCCTCCACCCTCCCAGGACATGGAATACA

CCACCCTCTCCCCCCGCACAGCCTTGAACATCTGAATGCCATTGGTGATGGACATGCTTTTGGTCTCCACGT

TCCACACAGTTTCAGAGCGAGCCAGTCTCGGGTCGGTCAGGGAGATGAAACCCTCCGGGCACTCCCGCATC

TGCACCTCACAGCTCAACAGCTGAGGATTGTCCTCGGTGGTCGGGATCACGGTTATCTGGAAGAAGCAGAA

GAGCGGCGGTGGGAATCATAGTCCGCGAACGGGATCGGCCGGTGGTGTCGCATCAGGCCCCGCAGCAGTC

GCTGCCGCCGCCGCTCCGTCAAGCTGCTGCTCAGGGGGTCCGGGTCCAGGGACTCCCTCAGCATGATGCCC

ACGGCCCTCAGCATCAGTCGTCTGGTGCGGCGGGCGCAGCAGCGCATGCGGATCTCGCTCAGGTCGCTGCA

GTACGTGCAACACAGAACCACCAGGTTGTTCAACAGTCCATAGTTCAACACGCTCCAGCCGAAACTCATCG

CGGGAAGGATGCTACCCACGTGGCCGTCGTACCAGATCCTCAGGTAAATCAAGTGGTGCCCCCTCCAGAAC

ACGCTGCCCACGTACATGATCTCCTTGGGCATGTGGCGGTTCACCACCTCCCGGTACCACATCACCCTCTGG

TTGAACATGCAGCCCCGGATGATCCTGCGGAACCACAGGGCCAGCACCGCCCCGCCCGCCATGCAGCGAA

GAGACCCCGGGTCCCGGCAATGGCAATGGAGGACCCACCGCTCGTACCCGTGGATCATCTGGGAGCTGAA

CAAGTCTATGTTGGCACAGCACAGGCATATGCTCATGCATCTCTTCAGCACTCTCAACTCCTCGGGGGTCAA

AACCATATCCCAGGGCACGGGGAACTCTTGCAGGACAGCGAACCCCGCAGAACAGGGCAATCCTCGCACA

GAACTTACATTGTGCATGGACAGGGTATCGCAATCAGGCAGCACCGGGTGATCCTCCACCAGAGAAGCGC

GGGTCTCGGTCTCCTCACAGCGTGGTAAGGGGCCGGCCGATACGGGTGATGGCGGGACGCGGCTGATCGT

GTTCGCGACCGTGTCATGATGCAGTTGCTTTCGGACATTTTCGTACTTGCTGTAGCAGAACCTGGTCCGGGC

GCTGCACACCGATCGCCGGCGGCGGTCTCGGCGCTTGGAACGCTCGGTGTTGAAATTGTAAAACAGCCACT

CTCTCAGACCGTGCAGCAGATCTAGGGCCTCAGGAGTGATGAAGATCCCATCATGCCTGATGGCTCTGATC

ACATCGACCACCGTGGAATGGGCCAGACCCAGCCAGATGATGCAATTTTGTTGGGTTTCGGTGACGGCGAG

CCTCGGGAACAACGATGAAGTAAATGCAAGCGGTGCGTTCCAGCATGGTTAGTTAGCTGATCTGTAGAAAA

AACAAAAATGAACATTAAACCATGCTAGCCTGGCGAACAGGTGGGTAAATCGTTCTCTCCAGCACCAGGCA

GGCCACGGGGTCTCCGGCGCGACCCTCGTAAAAATTGTCGCTATGATTGAAAACCATCACAGAGAGACGTT

CCCGGTGGCCGGCGTGAATGATTCGACAAGATGAATACACCCCCGGAACATTGGCGTCCGCGAGTGAAAA

AAAGCGCCCGAGGAAGCAATAAGGCACTACAATGCTCAGTCTCAAGTCCAGCAAAGCGATGCCATGCGGA

TGAAGCACAAAATTCTCAGGTGCGTACAAAATGTAATTACTCCCCTCCTGCACAGGCAGCAAAGCCCCCGA

TCCCTCCAGGTACACATACAAAGCCTCAGCGTCCATAGCTTACCGAGCAGCAGCACACAACAGGCGCAAG

AGTCAGAGAAAGGCTGAGCTCTAACCTGTCCACCCGCTCTCTGCTCAATATATAGCCCAGATCTACACTGA

CGTAAAGGCCAAAGTCTAAAAATACCCGCCAAATAATCACACACGCCCAGCACACGCCCAGAAACCGGTG

ACACACTCAAAAAAATACGCGCACTTCCTCAAACGCCCAAAACTGCCGTCATTTCCGGGTTCCCACGCTAC

GTCATCAAAACACGACTTTCAAATTCCGTCGACCGTTAAAAACGTCACCCGCCCCGCCCCTAACGGTCGCC

CGTCTCTCAGCCAATCAGCGCCCCGCATCCCCAAATTCAAACACCTCATTTGCATATTAACGCGCACAAAA

AGTTTGAGGTATATTATTGATGATG
```

Immune Monitoring Mice

Lymphocytes were isolated from freshly harvested spleens and lymph nodes of immunized mice. Tissues were dissociated in RPMI containing 10% fetal bovine serum with penicillin and streptomycin (complete RPMI) using the GentleMACS tissue dissociator according to the manufacturer's instructions. Freshly isolated lymphocytes at a density of $2\text{-}5\times10^6$ cells/mL were incubated with 10 uM of the indicated peptides for 2 hours. After two hours, brefeldin A was added to a concentration of 5 ug/ml and cells were incubated with stimulant for an additional 4 hours. Following stimulation, viable cells were labeled with fixable viability dye eFluor780 according to manufacturer's protocol and stained with anti-CD8 APC (clone 53-6.7, BioLegend) at 1:400 dilution. Anti-IFNg PE (clone XMG1.2, BioLegend) was used at 1:100 for intracellular staining. Samples were collected on an Attune NxT Flow Cytometer (Thermo Scientific). Flow cytometry data was plotted and analyzed using FlowJo. To assess degree of antigen-specific response, both the percent IFNg+ of CD8+ cells and the total IFNg+ cell number/$1\times10^6$ live cells were calculated in response to each peptide stimulant.

Immune Monitoring NHPs

PBMCs were isolated at indicated times after prime vaccination using Lymphocyte Separation Medium (LSM, MP Biomedicals) and LeucoSep separation tubes (Greiner Bio-One) and resuspended in RPMI containing 10% FBS and penicillin/streptomycin. Cells were counted on the Attune NxT flow cytometer (Thermo Fisher) using propidium iodide staining to exclude dead and apoptotic cells. Cell were then adjusted to the appropriate concentration of live cells for subsequent analysis. For each monkey in the studies, T cell responses were measured using ELISpot or flow cytometry methods. T cell responses to 6 different rhesus macaque Mamu-A*01 class I epitopes encoded in the vaccines were monitored from PBMCs by measuring induction of cytokines, such as IFN-gamma, using ex vivo enzyme-linked immunospot (ELISpot) analysis. ELISpot analysis was performed according to ELISPOT harmonization guidelines {DOI: 10.1038/nprot.2015.068} with the monkey IFNg ELISpotPLUS kit (MABTECH). 200,000 PBMCs were incubated with 10 uM of the indicated peptides for 16 hours in 96-well IFNg antibody coated plates. Spots were developed using alkaline phosphatase. The reaction was timed for 10 minutes and was terminated by running plate under tap water. Spots were counted using an AID vSpot Reader Spectrum. For ELISPOT analysis, wells with saturation >50% were recorded as "too numerous to count". Samples with deviation of replicate wells >10% were excluded from analysis. Spot counts were then corrected for well confluency using the formula: spot count+ 2×(spot count×% confluence/[100%−% confluence]). Negative background was corrected by subtraction of spot counts in the negative peptide stimulation wells from the antigen stimulated wells. Finally, wells labeled too numerous to count were set to the highest observed corrected value, rounded up to the nearest hundred.

Results

Figure 25:
FIG. 25 shows productivity, as assessed by IU titers, of the eight selected ChAdV68-MAG rapidly growing plaques compared to the non-purified pooled virus. Numbers above the columns on the graph indicate fold improvement over the pooled virus in a controlled infection at an MOI of 0.1.

Fast growing/fit ChAdV68 viruses that express the model TSNA cassette MAG (ChAdV68.5WTnt.MAG25mer; SEQ ID NO:2) were selected for during plaque isolation, as described. Of the original 75 plaques, 33 produced virus, as indicated by some signs of CPE (Cytopathic effect) and of those 8 grew more rapidly than the rest as indicated by significant plaque numbers or the size of plaques after 7 days of incubation. Rapidly growing clones were selected for virus production in 400 mL 293F (ThermoFisher cat. No. A14528) suspension cultures. Infectious units (IU) titers were determined for the 8 clones. As shown in FIG. 25, all selected clones demonstrated IU titers at or above the unpurified pooled virus reference. Clones 1, 24, and 60 demonstrated at least a 9-fold increase in IU titers relative to the unpurified pooled virus reference.

Figure 26:
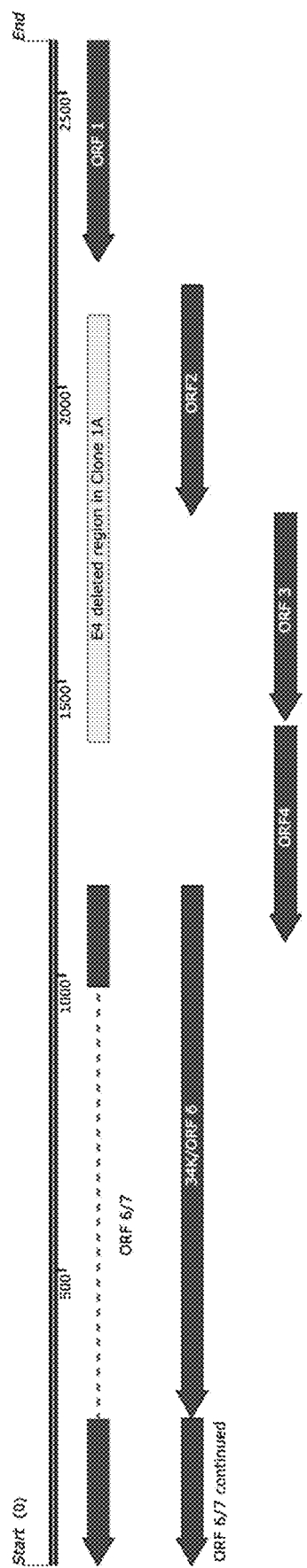
FIG. 26 shows a schematic of the E4 locus and the 727 bp deletion between E4orf2-E4orf4 identified in Clone 1A.

Clones 1, 24, and 60 (the 3 most productive clones) were further analyzed by NGS and indicated each contained deletions in the E4 region. Two of the clones (Clone 1A & clone 24) shared an identical 727 bp mutation between E4orf2-E4orf4 (FIG. 26), specifically between 34,916 to 35,642 bp of the wild-type ChAdV68 virus (SEQ ID NO: 1). Clone 60 was deleted in the E4orf1-E4orf3 region (34,980-36,516), but the deletion was larger (1539 bp). Based on these deletions Orf 2 & 3 deletions (34,979-35,642) are common to both clone sets suggesting the Orf 2 & 3 deletions contribute to the productivity improvement.

Figure 27:
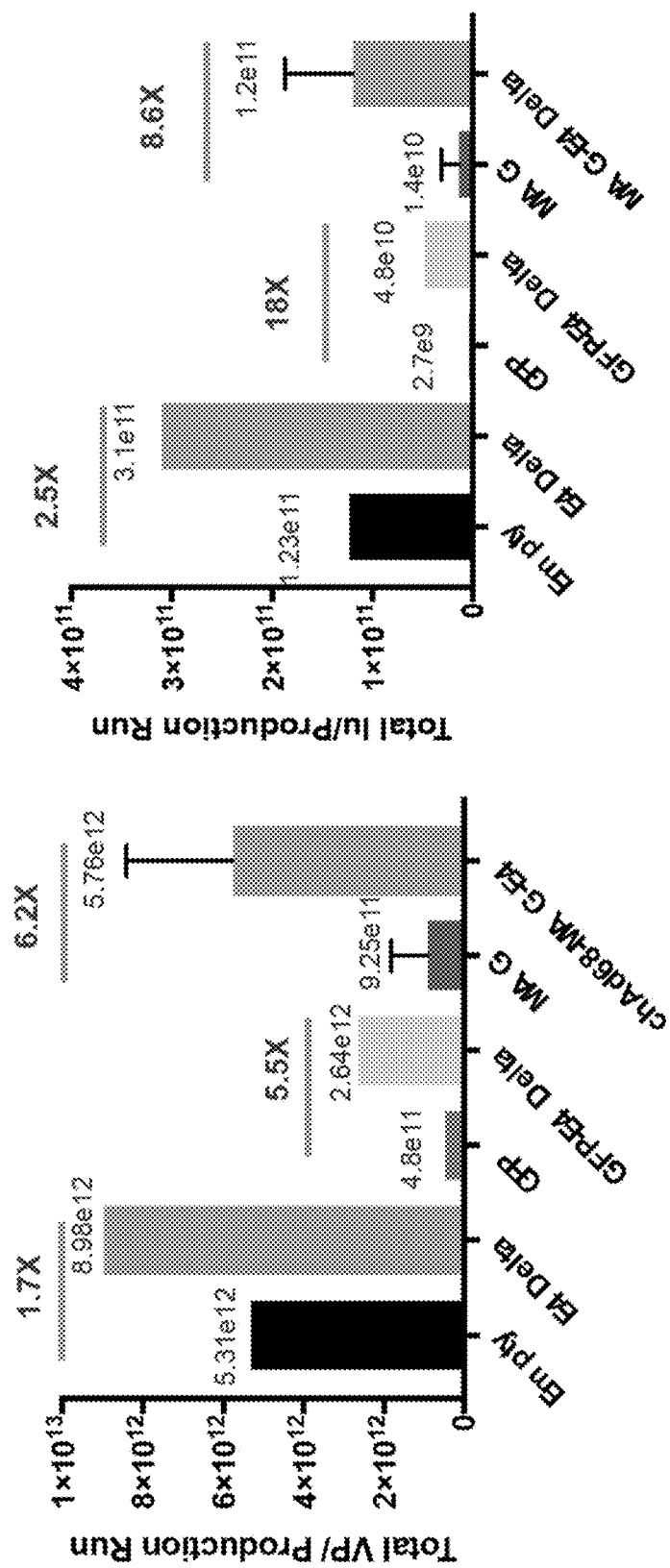
FIG. 27 shows virus productivity with viruses plus and minus the E4 deletion. Numbers above the bar indicate fold improvement over non-E4 deleted virus. The ChAdV68-MAG comparison to ChAdV68-MAG-E4 virus was performed on 3 separate occasions. In each case a 400 mL production run with both viruses was performed at an MOI of 1.0. Shown are viral particle (VP) titers (left panel) and infectious unit (IU) titers (right panel).

Three E4 deleted viral vectors were generated deleting the E4 region portion deleted in Clones 1A and 24 and compared with their original non-E4 deleted vectors. The vectors chosen were 1) ChAdV-Empty ("Empty") with no cassette or regulatory regions (promoter or poly-A) 2) ChAdV68.5WTnt.GFP (SEQ ID NO: 13; "GFP"), and 3) ChAdV68.5WTnt.MAG25mer (SEQ ID NO:2; "MAG"). They are all based on sequence AC_000011.1 with E1 (nt577 to 3403) and E3 deleted (nt 27,125-31,825) [SEQ ID NO: 1]. These were compared to the same vectors but deleted in the E4 region that we identified (34,916 to 35,642 of SEQ ID NO:1); ChAdV68-Empty-E4deleted (SEQ ID NO: 59; "E4 Delta"), ChAdV68-GFP-E4deleted (SEQ ID NO: 58; "GFP E4 Delta"), and ChAdV68-MAG-E4deleted (SEQ ID NO: 57; "MAG E4 Delta" and "ChAdV68-MAG-E4"), respectively. These six vectors were made and viral particle (VP) and infectious unit (IU) titers determined. Productivity was evaluated at the 400 mL production scale. As shown in FIG. 27, in each comparison the E4 deleted version demonstrated increased viral particle titers (left panel) and infectious unit titers (right panel).

Figure 28:
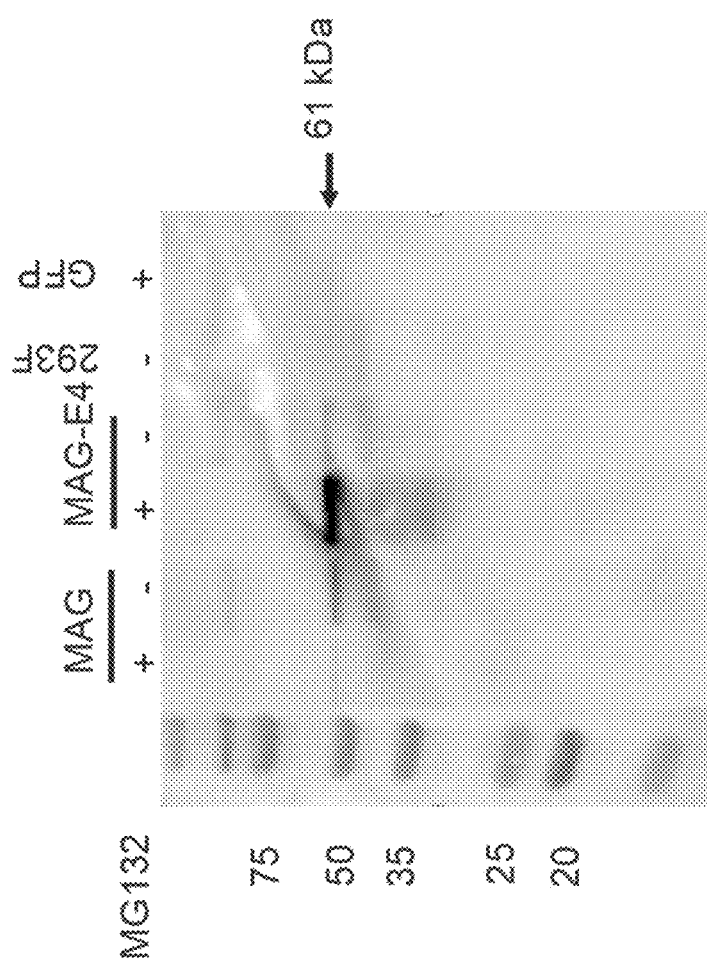
FIG. 28 shows a Western blot analysis of MAG expression using rabbit anti-class II epitope antibody expression in cells infected with ChAdV68.5WTnt.MAG25mer ("MAG") and ChAdV68-MAG-E4deleted ("MAG-E4") viruses. Samples were treated with and without the proteasome inhibitor, MG-132, as indicated by plus and minus signs.

Expression of the MAG cassette was compared between E4 deleted and non-deleted vectors. As shown in FIG. 28, Western analysis on HEK293F cell lysates infected with ChAdV68.5WTnt.MAG25mer ("MAG") and ChAdV68-MAG-E4deleted ("MAG-E4") viruses indicated that the E4 deleted virus had higher levels of the MAG cassette expressed compared to the non E4-deleted viruses.

Figure 42A:
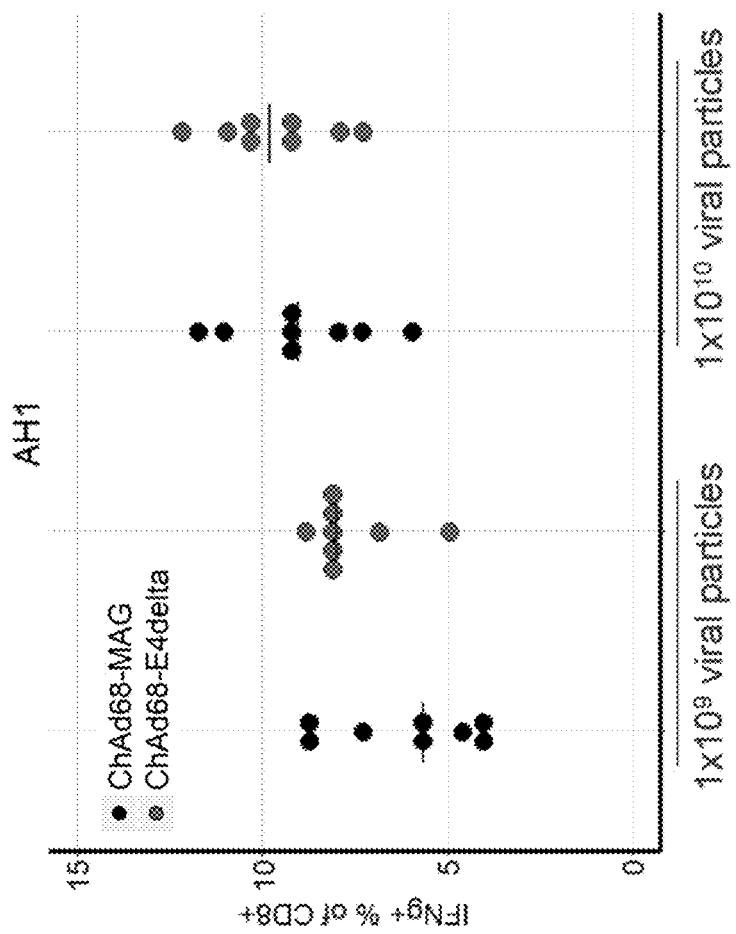
FIG. 42A shows the CD8+ immune responses by assessing IFN-gamma production by ICS following stimulation with an AH1 (a dominant epitope from Murine leukemia virus envelope protein gp70) in ChAdV68-MAG and ChAdV68-E4delta-MAG vector treated Balb/c mice. Balb/c mice were immunized by bilateral injection of 50 uL of virus into the Quadriceps (100 uL in total, 50 uL/leg).

Mice were then immunized comparing the ChAdV68.5WTnt.MAG25mer ("ChAdV68-MAG") and its E4-deleted counterpart ChAdV68-MAG-E4deleted ("ChAdV68-E4delta"). T cell responses were analyzed for IFN-gamma production by ICS following stimulation with an AH1 peptide. As shown in FIG. 42A and Table 41A, immunization with the E4-deleted vector demonstrated at least equivalent immune responses at both doses tested ($1\times10^9$ left panel, $1\times10^{10}$ right panel), with a positive trend towards an increased response in E4-deleted vectors.

TABLE 41A

IFN-gamma production by E4 deleted ChAdV68 (ICS)

| Treatment | Dose | Average IFNg + as % of CD8 | Standard deviation | N |
|---|---|---|---|---|
| ChAdV68-MAG | 1.00E+10 | 1.040875 | 0.211938 | 8 |
| ChAdV68-E4delta | 1.00E+10 | 1.084125 | 0.213109 | 8 |
| ChAdV68-MAG | 1.00E+09 | 0.61575 | 0.202046 | 8 |
| ChAdV68-E4delta | 1.00E+09 | 0.800125 | 0.189558 | 8 |

Figure 42C:
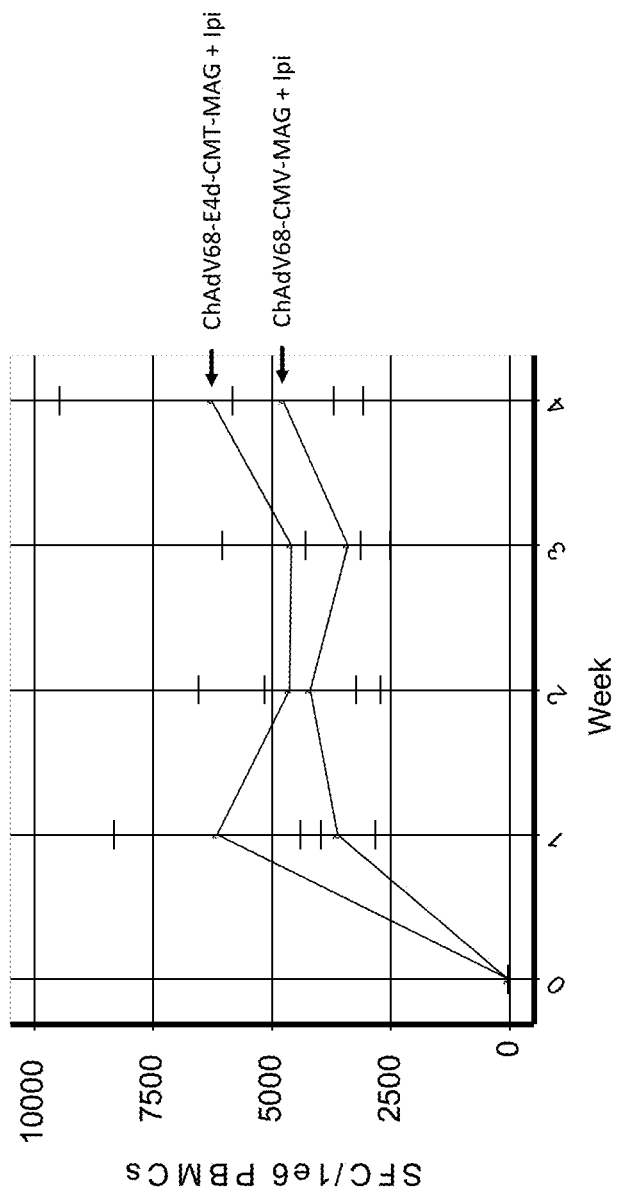
FIG. 42C shows T cell responses by assessing IFN-gamma production by ELISpot following stimulation with 6 different rhesus macaque Mamu-A*01 class I epitopes over a time course in Rhesus macaques were immunized with ChAdV68-CMV-MAG (left panel) and ChAdV68-E4d-CMT-MAG (right panel), and both conditions administered an anti-CTLA4 antibody (Ipilimumab).

Rhesus macaques were then immunized with ChAdV68.5WTnt.MAG25mer ("ChAdV68-CMV-MAG"; SEQ ID NO:2) or ChAdV68-E4d-CMT-MAG (SEQ ID NO:71), with each group also administered an anti-CTLA4 antibody (Ipilimumab). T cell responses were analyzed for IFN-gamma production by ELISpot following stimulation with 6 different rhesus macaque Mamu-A*01 class I epitopes. As shown in FIG. 42B and FIG. 42C, and quantified in Table 41B (ChAdV68-CMV-MAG) and Table 41C (ChAdV68-E4d-CMT-MAG), immunization with the E4-deleted vector demonstrated at least equivalent immune responses, with a positive trend towards an increased response in E4-deleted vectors.

TABLE 41B

Mean spot forming cells (SFC) per $10^6$ PBMCs for each epitope ± SEM for ChAdV68-CMV-MAG

| | Antigen | | | | | |
|---|---|---|---|---|---|---|
| Wk | Env CL9 | Env TL9 | Gag CM9 | Gag LW9 | Pol SV9 | Tat TL8 |
| 1 | 531 +/− 131 | 950 +/− 215 | 654 +/− 216 | 14 +/− 6 | 12 +/− 0 | 1460 +/− 272 |
| 2 | 399 +/− 74 | 887 +/− 159 | 924 +/− 351 | 0 +/− 0 | 0 +/− 0 | 1986 +/− 434 |
| 3 | 312 +/− 101 | 616 +/− 155 | 675 +/− 212 | 0 +/− 0 | 0 +/− 0 | 1795 +/− 481 |
| 4 | 533 +/− 151 | 851 +/− 129 | 1011 +/− 207 | 10 +/− 7 | 73 +/− 12 | 2290 +/− 729 |

TABLE 41C

Mean spot forming cells (SFC) per $10^6$ PBMCs for each epitope ± SEM for ChAdV68-E4d-CMT-MAG

| | Antigen | | | | | |
|---|---|---|---|---|---|---|
| Wk | Env CL9 | Env TL9 | Gag CM9 | Gag LW9 | Pol SV9 | Tat TL8 |
| 1 | 1037 +/− 285 | 966 +/− 287 | 1341 +/− 470 | 20 +/− 13 | 10 +/− 9 | 2777 +/− 1180 |
| 2 | 707 +/− 376 | 905 +/− 343 | 1217 +/− 543 | 0 +/− 0 | 0 +/− 0 | 1805 +/− 681 |
| 3 | 612 +/− 302 | 1038 +/− 361 | 1040 +/− 474 | 0 +/− 0 | 0 +/− 0 | 1906 +/− 462 |
| 4 | 1237 +/− 722 | 1282 +/− 665 | 1487 +/− 760 | 3 +/− 2 | 183 +/− 122 | 2084 +/− 943 |

XXI. Construction of a TETr-Regulated Cassette Expression System

Figure 43:
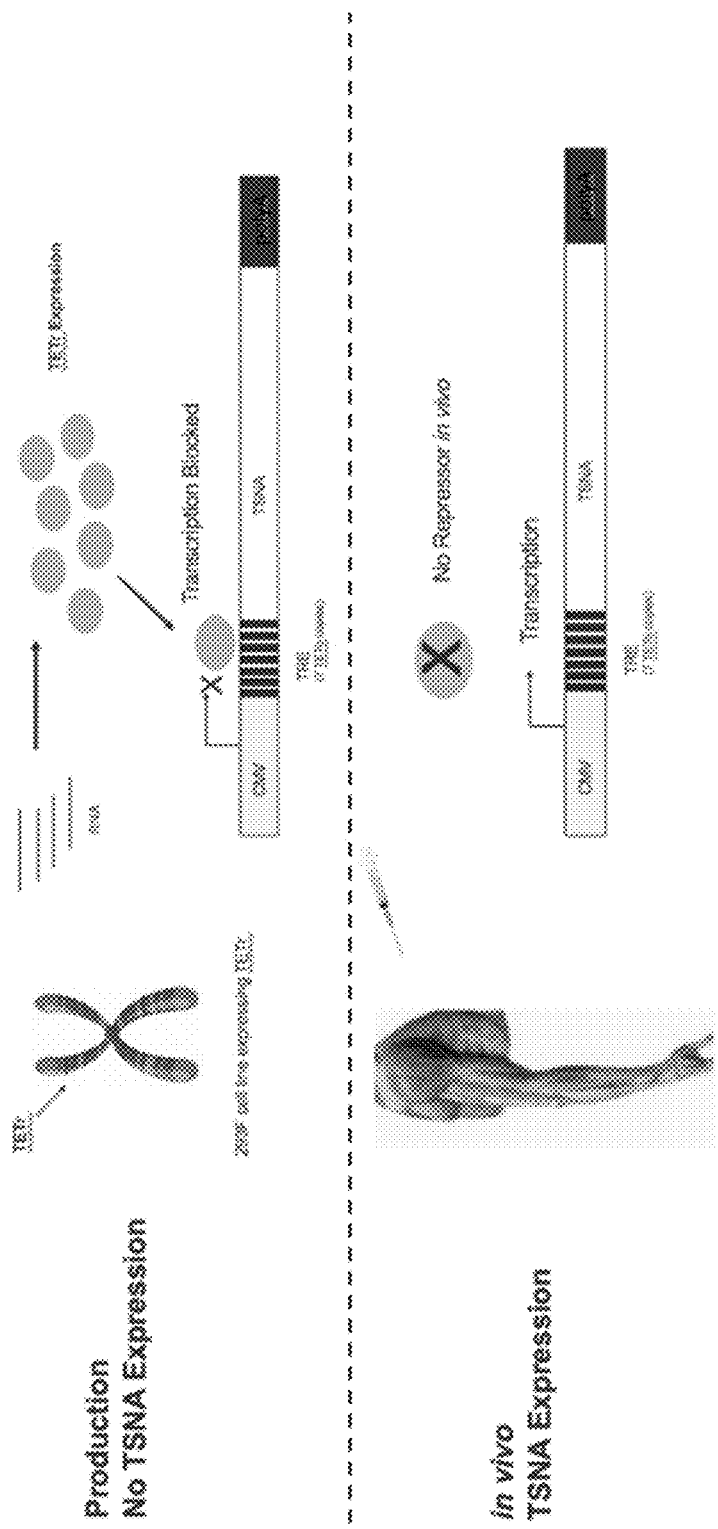
FIG. 43 illustrates the general strategy for a tetracycline-controlled viral production system using the example of antigen encoding vaccine.
Figure 44A:
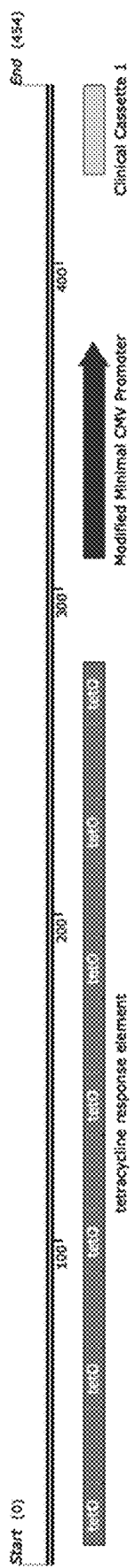
FIG. 44A presents a schematic showing arrangement of a "TETo" response region in reference to the promoter and cassette to be expressed.

A TETr-regulated viral expression system was established to minimize transcription of nucleic acids encoded in a cassette, such as an antigen encoding cassette in a vaccine, during viral production. FIG. 43 illustrates the general strategy for one example of a tetracycline-controlled viral production system using the example of antigen encoding vaccine, namely:
  293F cells expressing a TET repressor protein (TETr) repress expression of the vaccine cassette by binding to the TET operator sequence upstream of a minimal CMV promoter
  Transcription of the cassette sequence facilitates Adenovirus production without the influence of cassette expression
  Once administered in vivo, no repressor is present, and transcription of the cassette can proceed unimpeded FIG. 44A presents a schematic showing arrangement of one example of a TET response region, referred to as a "TETo" response region, in reference to the promoter and cassette to be expressed. The TET response region consists of seven repeats of the 19 bp TET operator (TETo) sequence (TCCCTATCAGTGATAGAGA; SEQ ID NO:60) linked with spacers (aaagtgaaagtcgagtttaccac; SEQ ID NO:70) between each TETo. The TET response region is upstream (5') of the minimal CMV promoter (67 bp; see SEQ ID NO:61) and the start of the cassette location. The arrangement of the TETo response region and promoter sequences are shown and described in SEQ ID NO:61.

Figure 44B:
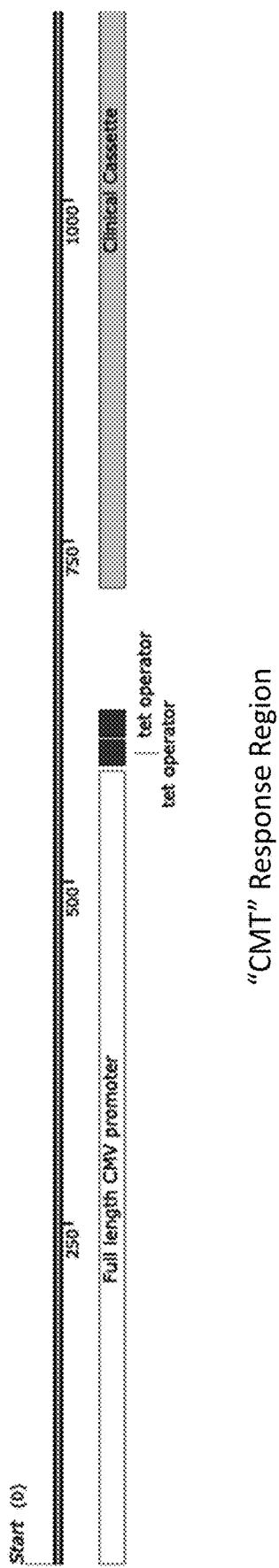
FIG. 44B presents a schematic showing arrangement of a "CMT" response region in reference to the promoter and cassette to be expressed.

FIG. 44B presents a schematic showing arrangement of another example of a TET response region, referred to as a "CMT" response region, in reference to the promoter and cassette to be expressed. The TET response region includes two repeats of the 19 bp TET operator (TETo) sequence (TCCCTATCAGTGATAGAGA; SEQ ID NO:60) linked together with a two nucleotide spacer. The TET response region is downstream (3') of a full-length CMV promoter (605 bp; see SEQ ID NO: 64) and upstream (5') of the start of the cassette location. The arrangement of the CMT response region and promoter sequences are shown and described in SEQ ID NO:64.

The TETo response region was inserted between the I-SceI and AsisI sites of ChAdV68.5WTnt.GFP (SEQ ID NO: 13) to generate ChAdV68-TETo-GFP. A TETr sequence (tTS; SEQ ID NO: 62) was cloned into a Lentivirus pLX vector to generate pLXCMV-tTS-iPuro and used to transduce 293F cells. Sequences used in constructing the system are presented below. A clonal 293F TETr line was generated after Puromycin selection. GFP transgene expression was evaluated to assess expression regulation by the TETr line in vitro. As shown in FIG. 45A, following infection with ChAdV68-TETo-GFP virus, GFP was significantly reduced in 293F cells expressing the TETr (Clone 17, right panel) relative to the parental 293F cell line (left panel).

Figure 45B:
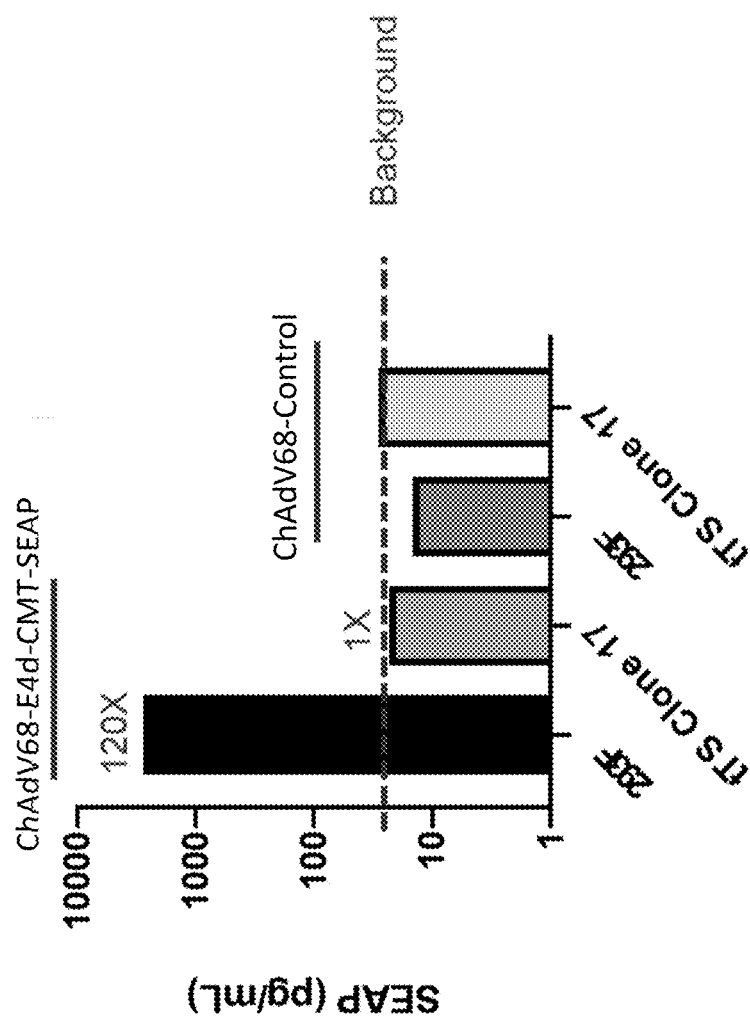
FIG. 45B shows TETr mediated regulation of SEAP expressed from a ChAdV68 vector with a CMT sequence. SEAP is significantly reduced in 293F cells expressing the TETr (Clone 17, second column from left) relative to the parental 293F cell line (left column). Background signal was established using a ChAdV68 vector expressing a control expression cassette (right two columns). 293F cells were infected at an MOI of 0.3 and 24 h later media was harvested for the SEAP assay (Phospha-Light™ System (Applied Biosystems) using a chemiluminescent substrate for the detection of secreted alkaline phosphatase) that was followed according to the manufacturers description.

A secreted embryonic alkaline phosphatase SEAP reporter construct was generated using the CMT response region inserted between the I-SceI and AsisI sites of ChAdV68-Empty-E4deleted (SEQ ID NO:59) and with SEAP inserted in place of the deleted E1 ("ChAdV68-E4d-CMT-SEAP"). 293F cells were infected at an MOI of 0.3 and 24 h later media was harvested for the SEAP assay (Phospha-Light™ System (Applied Biosystems) using a chemiluminescent substrate for the detection of secreted alkaline phosphatase) that was followed according to the manufacturers description. As shown in FIG. 45B, following infection with ChAdV68-E4d-CMT-SEAP virus, SEAP secretion was reduced 120-fold to background level in 293F cells expressing the TETr ("tTS Clone 17"), with background set using a ChAdV68 vector expressing a control expression cassette, relative to the parental 293F cell line ("293F"). Thus, adenoviral cassettes expressed from a TETr-controlled promoter demonstrate reduced cassette expression when used in TETr-expressing cell lines in vitro.

```
TETo response region between I-SceI and AsisI sites of ChAdV68 vector backbone.
(SEQ ID NO: 61) One of seven repeats of the 19 bp TETo sequences is bold
italicized. The minimal CMV promoter is bold
ccatgttgacattgattattgactagttattaaagtact tccctatcagtgatagaga aaagtgaaagtcgagtttacca ctccctatcagtgatagagaaaagtgaaagtcgagtttaccactccctatcagtgatagagaaaagtgaaagtcgagttt accactccctatcagtgatagagaaaagtgaaagtcgatattaccactccctatcagtgatagagaaaagtgaaagtcga gtttaccactccctatcagtgatagagaaaagtgaaagtcgaccactccctatcagtgatagagaaaagtgaaagtcgag acggtacccggctcga ggtaggcgtgtacggtgggaggcctatataagcagagctcgtttagtgaaccgtcagatcg cctggag TETr sequence (tTS) nucleic acid sequence (SEQ ID NO: 62)
ATGAGCAGACTGGACAAGAGCAAAGTGATCAACAGCGCCCTGGAACTGCTGAACGAAGTGGGCATCGAGG

GCCTGACAACCAGAAAGCTGGCCCAGAAGCTGGGCGTTGAGCAGCCTACACTGTATTGGCACGTGCGGAA

CAAGCAGACCCTGATGAATATGCTGAGCGAGGCCATCCTGGCCAAGCACCATACAAGATCTGCCCCTCTGC

CAACCGAGAGCTGGCAGCAGTTTCTGCAAGAGAACGCCCTGAGCTTCAGAAAGGCCCTGCTGGTGCATAG

AGATGGCGCCAGACTGCACATCGGCACATCTCCCACACCTCCACAGTTTGAGCAGGCTGAGGCACAGCTGA

GATGTCTGTGTGATGCCGGCTTTAGCGTGGAAGAGGCCCTGTTCATCCTGCAGTCCATCAGCCACTTTACAC

TGGGCGCCGTGCTGGAAGAACAGGCCACCAACCAGATCGAGAACAACCACGTGATCGACGCTGCCCCTCC

ACTGCTGCAAGAGGCCTTCAATATCCAAGCCAGAACCAGCGCCGAGATGGCCTTCCACTTTGGCCTGAAGT

CCCTGATCTTTGGCTTCAGCGCCCAGCTGGACGAGAAGAAGCACACACCTATCGAGGACGGCAACAAGCCC

AAGAAGAAGCGGAAGCTGGCCGTCAGCGTGACCTTTGAAGATGTGGCCGTGCTGTTCACCCGGGACGAGT

GGAAGAAACTGGACCTGAGCCAGCGGAGCCTGTACCGGGAAGTGATGCTGGAAAACTACAGCAACCTGGC

CTCCATGGCCGGCTTTCTGTTCACCAAGCCTAAAGTGATCTCCCTGCTTCAGCAGGGCGAAGATCCTTGGTA

A

TETr sequence (tTs) amino acid sequetic (SEQ ID NO: 63)
MSRLDKSKVINSALELLNEVGIEGLTTRKLAQKLGVEQPTLYWHVRNKQTLMNMLSEAILAKHHTR

SAPLPTESWQQFLQENALSFRKALLVHRDGARLHIGTSPTPPQFEQAEAQLRCLCDAGFSVEEALFIL

QSISHFTLGAVLEEQATNQIENNHVIDAAPPLLQEAFNIQARTSAEMAFHFGLKSLIFGFSAQLDEKK

HTPIEDGNKPKKKRKLAVSVTEDVAVLFTRDEWKKLDLSQRSLYREVMLENYSNLASMAGFLFTK

PKVISLLQQGEDPW

CMT response region between I-SceI and AsisI sites of ChAdV68 vector backbone.
(SEQ ID NO: 64) The two repeats of the 19 bp TETo sequences are bolded.
The full-length CMV promoter is italicized.
GACATTGATTATTGACTAGTTGTTAATAGTAATCAATTACGGGGTCATTAGTTCATAGCCCATAT

ATGGAGTTCCGCGTTACATAACTTACGCTTAAATGGCCCGCCTGGCTGACCGCCCAACGACCCCCGCC

CATTGACGTCAATAATGACGTATGTTCCCATAGTAACGCCAATAGGGACTTTCCATTGACGTCAATGGG

TGGAGTATTTACGGTAAACTGCCCACTTGGCAGTACATCAAGTGTATCATATGCCAAGTCCGCCCCCTA

TTGACGTCAAGTACGGTAAATGGCCCGCCTGGCATTATGCCCAGTACATGACCTTACGGGACTTTCCT

ACTTGGCACTTACATCTACGTATTAGTCATCGCTAATTACCATCTGTGTGCGGTTTTGGCAGTACACCAAT

GGGCGTGGATAGCGGTTTGACTCACGGGGATTTCCAAGTCTCCACCCCATTGACGTCAATGGGAGTTT
```

```
GTTTTGGCACCAAAATCAACGGGACTTTCCAAAATGTCGTAATAACCCCGCCCCGTTGACGCAAATGG

GCGGTAGGCGTGTACGGTGGGAGGTCTATATAAGCAGAGCTCTCCCTATCAGTGATAGAGATCTC

CCTATCAGTGATAGAGATC
```

XXII. Viral Production in the TETr-Regulated Cassette Expression System

Figure 46:
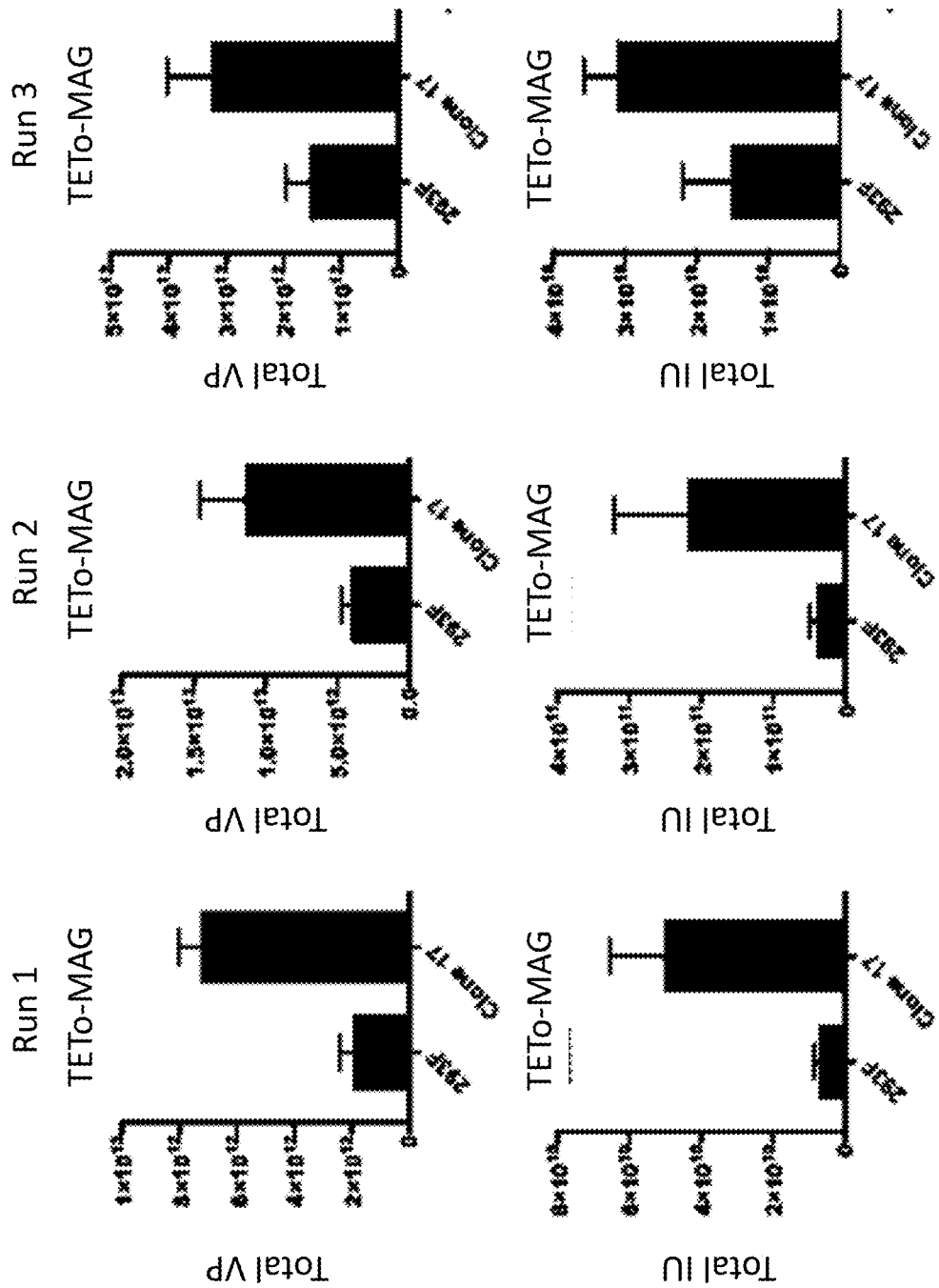
FIG. 46 shows viral production for a ChAdV68-Teto-MAG vector in a 293F TETr repressor line (Clone 17) relative to production in the parental 293F line. The experiment was performed in triplicate (run 1-3). In each experiment 400 mL of 293F cells were infected at an MOI of approximately 3 and incubated for 48-72 h before harvesting. Virus was purified by two discontinuous CsCl ultracentrifugation steps and dialyzed into storage buffer. Viral particles were measured by Absorbance at 260 nm. Shown are viral particle (VP; top panels) and infectious unit (IU; bottom panels) titers.

The TETo response region was inserted between the I-SceI and AsisI sites of ChAdV68.5WTnt.MAG25mer ("ChAdV68-CMV-MAG"; SEQ ID NO:2) to generate a ChAdV68-TETo-MAG virus (SEQ ID NO:65) expressing a model antigen cassette under control of a TET regulated promoter. Viral production was compared between cell lines expressing TETr (Clone 17) and the parental cell line that did not express TETr (293F). As shown in FIG. 46, viral production was improved as assessed by viral particle (VP; top panels) and infectious unit (IU; bottom panels) titers across three independent replicates.

Figure 47A:
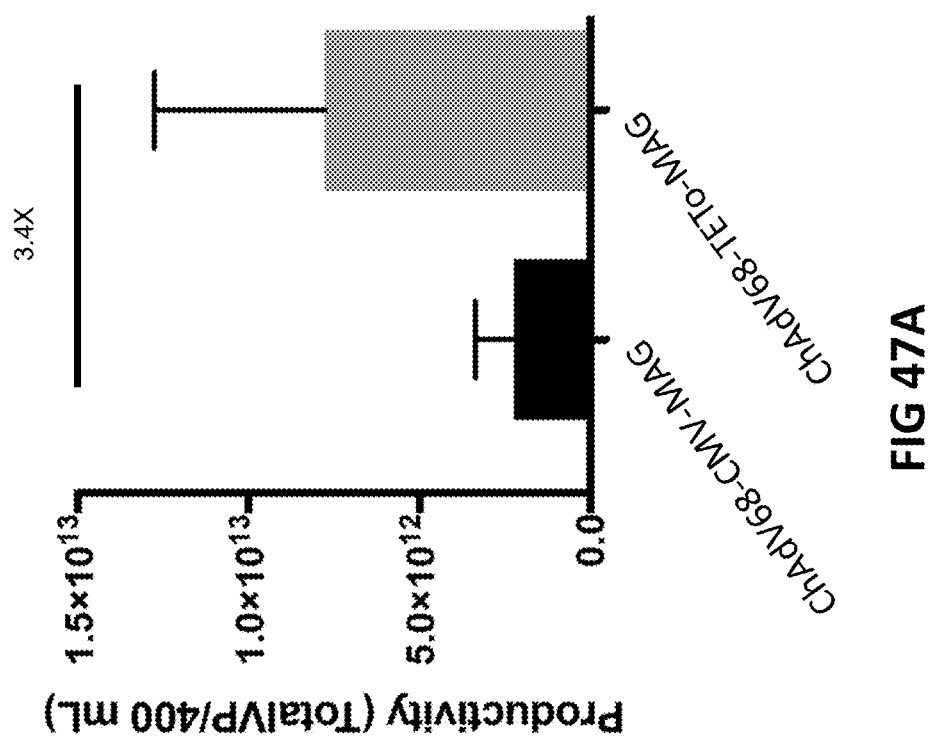
FIG. 47A shows overall productivity of a Tet regulated virus ("TETo-MAG") in a 293F TETr line (Clone 17) relative to a non-regulated virus ("MAG") with the same cassette in a normal 293F cell line. Shown are date from multiple 400 mL production runs followed by centrifugation. Fold improvement with Tet regulated virus is indicated by the number above the graph.

Viral production of a ChAdV68-TETo-MAG virus produced in a cell line expressing TETr (Clone 17) was also compared to a virus lacking the TETo sequences ("ChAdV68-CMV-MAG"). As shown in FIG. 47A, viral production was improved by 3.4-fold for the ChAdV68-TETo-MAG virus relative to ChAdV68-CMV-MAG. These results indicate reduction in in vitro expression of the delivered cassette transgenes translated into more consistent and improved virus productivity.

Viral production produced in a cell line expressing TETr (tTS Clone 17) was further compared for a series of viral constructs, including constructs featuring E4 deletions and TET response elements. The constructs all expressed the same, control tumor-specific neoantigen (TSNA) cassette. The general backbone featuring E1/E3 deletions and 5 nucleotide substitutions was the same as ChAdV68.5WTnt.MAG25mer (SEQ ID NO:2), with TETo and CMT response regions inserted between the I-SceI and AsisI sites, as indicated, and the MAG25mer cassette substituted for the TSNA cassette. The deleted E4 region was that identified above (deletion 34,916 to 35,642 of SEQ ID NO:1). The various constructs examined are described below:

ChAdV68-CMV-TSNA; E1/E3 deleted, full-length CMV promoter

ChAdV68-CT-TSNA; E1/E3 deleted, full-length CMV promoter, TSNA cassette codon optimized using an alternate codon optimization (SEQ ID NO:66)

ChAdV68-TETo-TSNA; E1/E3 deleted, 7 repeats of TETo linked with spacers upstream (5') of minimal CMV promoter ("TETo" response region) (SEQ ID NO:67)

ChAdV68-CMT-TSNA; E1/E3 deleted, 2 repeats of TETo directly linked together downstream (3') of full-length CMV promoter ("CMT" response region) (SEQ ID NO:68)

ChAdV68-E4d-CMT-TSNA; E1/E3/E4 deleted, 2 repeats of TETo directly linked together downstream (3') of full-length CMV promoter (SEQ ID NO:69)

Figure 47B:
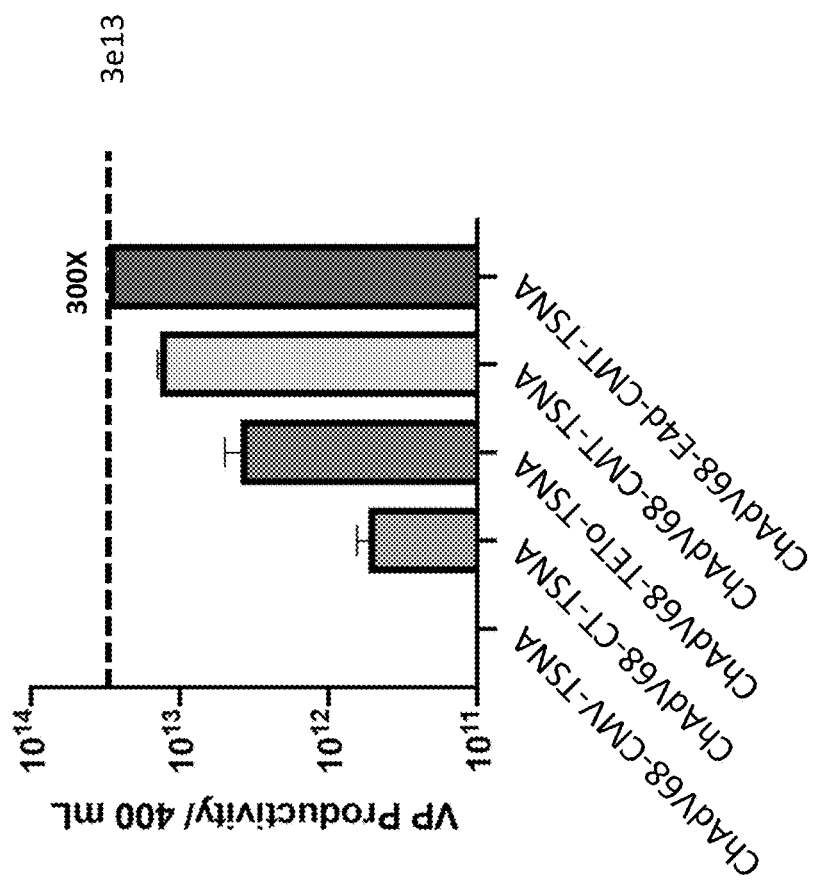
FIG. 47B shows viral production for the ChAdV68-CT-TSNA, ChAdV68-TETo-TSNA, ChAdV68-CMT-TSNA, and ChAdV68-E4d-CMT-TSNA viruses relative to ChAdV68-CMV-TSNA.

As shown in FIG. 47B, viral production for the ChAdV68-CT-TSNA, ChAdV68-TETo-TSNA, ChAdV68-CMT-TSNA, and ChAdV68-E4d-CMT-TSNA viruses was improved by about 6-fold, 39-fold, 137-fold, or 300-fold relative to ChAdV68-CMV-TSNA. respectively. The ratio of viral particles to infectious units was also assessed to measure the virus's infectious capability and is calculated by dividing the virus particle (VP) titer/mL by the infectious unit (IU) titer/mL, where a lower ratio represents a higher infectivity per particle (a ratio of 1:1 represents a perfect ratio of every particle being infectious). As shown in Table 42A, TET-controlled vectors ChAdV68-TETo-TSNA, ChAdV68-CMT-TSNA, and ChAdV68-E4d-CMT-TSNA all demonstrated improved infectious capability relative to ChAdV68-CMV-TSNA, with CMT vectors demonstrating the best infectious capability.

Figure 47C:
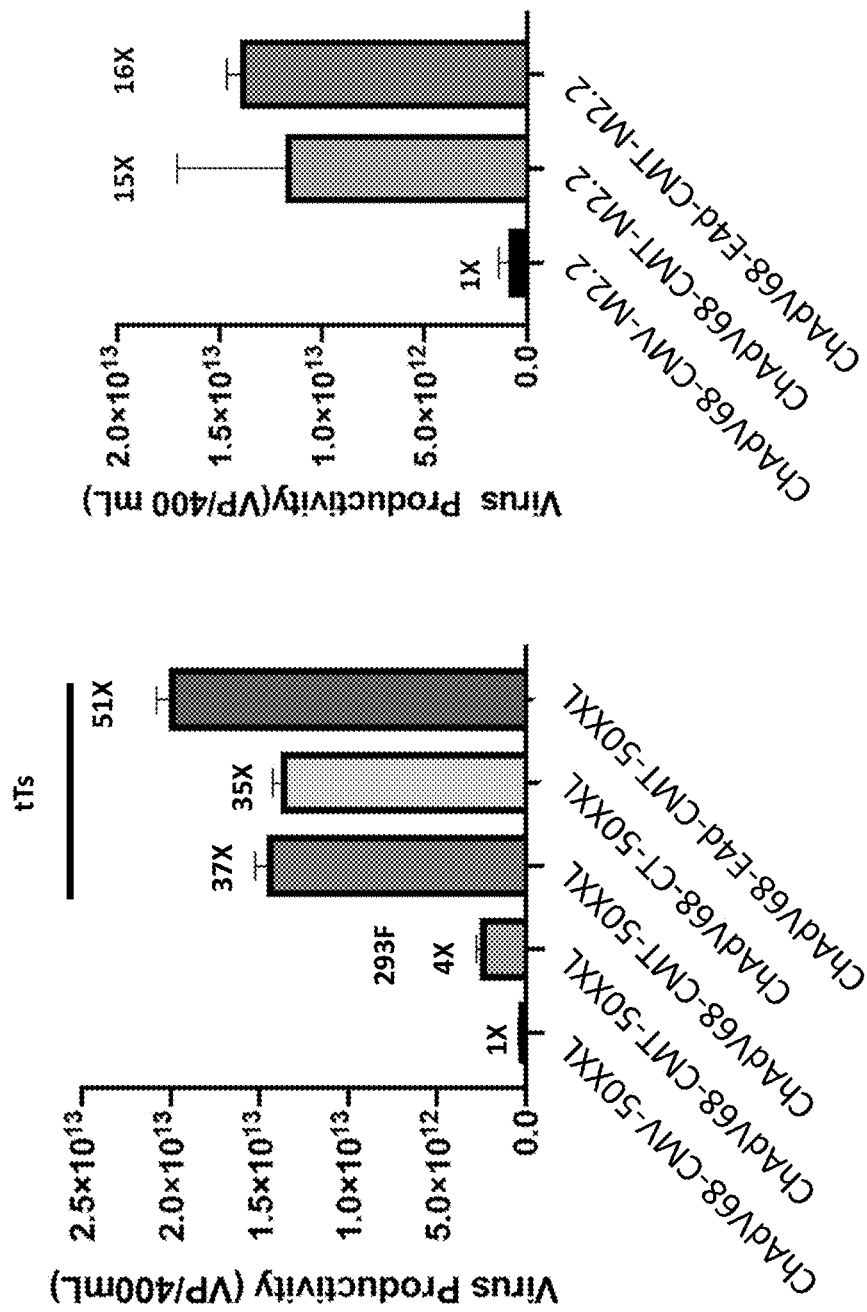
FIG. 47C shows viral production for model antigen cassettes 50XXL and M2.2 using adenoviral vectors having a CMT response region in a tTS expressing cell line.

Viral production of another series of viral constructs, including constructs featuring E4 deletions and TET response elements, was assessed for constructs featuring either a large model antigen cassette (50XXL; see FIG. 29 and Tables 32-34) or M2.2 model antigen cassette. The general backbone featuring E1/E3 deletions and 5 nucleotide substitutions was the same as ChAdV68.5WTnt.MAG25mer (SEQ ID NO:2), with TETo and CMT response regions inserted between the I-SceI and AsisI sites, as indicated, and the MAG25mer cassette substituted for the indicated cassettes. The deleted E4 region was that identified above (deletion 34,916 to 35,642 of SEQ ID NO:1). The various constructs examined are described below:

ChAdV68-CMV-50 XXL; E1/E3 deleted, full length CMV promoter, 50XXL cassette codon optimized using Genscript codon optimization tool ChAdV68-CMT-50XXL; E1/E3 deleted, 2 repeats of TETo directly linked together downstream (3') of full-length CMV promoter, 50XXL cassette codon optimized using Genscript codon optimization tool ChAdV68-CT-50XXL; E1/E3 deleted, full length CMV promoter, 50XXL cassette codon optimized using an alternate codon optimization tool ChAdV68-E4d-CMT-50XXL; E1/E3/E4 deleted, 2 repeats of TETo directly linked together downstream (3') of full-length CMV promoter; 50XXL cassette codon optimized using Genscript codon optimization tool ChAdV68-CMV-M2.2; E1/E3 deleted, full length CMV promoter, M2.2 cassette codon optimized using Genscript codon optimization tool ChAdV68-CMT-M2.2; E1/E3 deleted, 2 repeats of TETo directly linked together downstream (3') of full-length CMV promoter, M2.2 cassette codon optimized using Genscript codon optimization tool ChAdV68-E4d-CMT-M2.2; E1/E3/E4 deleted, 2 repeats of TETo directly linked together downstream (3') of full-length CMV promoter, M2.2 cassette codon optimized using Genscript codon optimization tool As shown in FIG. 47C, viral production for model antigen cassettes 50XXL and M2.2 was improved by the use adenoviral vectors having a CMT response region in a tTS expressing cell line. For example, viral production was almost 10-fold greater for ChAdV68-CMT-50XXL in the tTS expressing cell line (left panel; middle column) relative to a parental 293F cell line (left panel; second column from left), and 15-fold greater for ChAdV68-CMT-M2.2 (right panel; middle column) relative to a vector lacking the CMT response region in a parental 293F cell line (right panel; left column). In the case of 50XXL constructs, further improvements in viral production were achieved by combining a CMT response region with an E4 deletion (left panel middle column vs left panel right column). Improvements were also achieved under certain circumstances by alternative codon optimization (as shown for ChAdV68-CT-50XXL). The ratio of viral particles to infectious units was also assessed. As shown in Table 42C, TET-controlled vectors in a E4 deleted background all demonstrated improved infectious capability relative to vectors without an E4 deletion and TET response element.

TABLE 42A

Viral particle to infectious unit ratio TSNA constructs

| Construct | VP:IU Ratio |
| --- | --- |
| ChAdV68-CMV-TSNA | 591:1 |
| ChAdV68-CT-TSNA | 63:1 |

TABLE 42A-continued

Viral particle to infectious unit ratio TSNA constructs

| Construct | VP:IU Ratio |
| --- | --- |
| ChAdV68-TETo-TSNA | 135:1 |
| ChAdV68-CMT-TSNA | 22:1 |
| ChAdV68-E4d-CMT-TSNA | 34:1 |

TABLE 42B

Viral particle to infectious unit ratio 50XXL constructs

| Construct | VP:IU Ratio |
| --- | --- |
| ChAdV68-CMV-50XXL | 260:1 |
| ChAdV68-E4d-CMT-50XXL | 32:1 |
| ChAdV68-CMV-M2.2 | 662:1 |
| ChAdV68-E4d-CMT-M2.2 | 50:1 |

```
ChAdV68-TETo-MAG (SEQ ID NO: 65)
CATCATCAATAATATACCTCAAACTTTTTGTGCGCGTTAATATGCAAATGAGGCGTTTGAATTTGGGGAGGA

AGGGCGGTGATTGGTCGAGGGATGAGCGACCGTTAGGGGCGGGGCGAGTGACGTTTTGATGACGTGGTTG

CGAGGAGGAGCCAGTTTGCAAGTTCTCGTGGGAAAAGTGACGTCAAACGAGGTGTGGTTTGAACACGGAA

ATACTCAATTTTCCCGCGCTCTCTGACAGGAAATGAGGTGTTTCTGGGCGGATGCAAGTGAAAACGGGCCA

TTTTCGCGCGAAAACTGAATGAGGAAGTGAAAATCTGAGTAATTTCGCGTTTATGGCAGGGAGGAGTATTT

GCCGAGGGCCGAGTAGACTTTGACCGATTACGTGGGGGTTTCGATTACCGTGTTTTTCACCTAAATTTCCGC

GTACGGTGTCAAAGTCCGGTGTTTTTACGTAGGTGTCAGCTGATCGCCAGGGTATTTAAACCTGCGCTCTCC

AGTCAAGAGGCCACTCTTGAGTGCCAGCGAGAAGAGTTTTCTCCTCCGCGCCGCGAGTCAGATCTACACTT

TGAAAGTAGGGATAACAGGGTAATCCATGTTGACATTGATTATTGACTAGTTATTAAAGTACTTCCCTATCA

GTGATAGAGAAAAGTGAAAGTCGAGTTTACCACTCCCTATCAGTGATAGAGAAAAGTGAAAGTCGAGTTTA

CCACTCCCTATCAGTGATAGAGAAAAGTGAAAGTCGAGTTTACCACTCCCTATCAGTGATAGAGAAAAGTG

AAAGTCGAGTTTACCACTCCCTATCAGTGATAGAGAAAAGTGAAAGTCCGAGTTTACCACTCCCTATCAGTG

ATAGAGAAAAGTGAAAGTCGAGTTTACCACTCCCTATCAGTGATAGAGAAAAGTGAAAGTCGAGCTCGGT

ACCCGGGTCGAGGTAGGCGTGTACGGTGGGAGGCCTATATAAGCAGAGCTCGTTTAGTGAACCGTCAGATC

GCCTGGAGACGCCATCCACGCTGTTTTGACCTCCATAGAAGACAGCGATCGCGCCACCATGGCCGGGATGT

TCCAGGCACTGTCCGAAGGCTGCACACCCTATGATATTAACCAGATGCTGAATGTCCTGGGAGACCACCAG

GTCTCTGGCCTGGAGCAGCTGGAGAGCATCATCAACTTCGAGAAGCTGACCGAGTGGACAAGCTCCAATGT

GATGCCTATCCTGTCCCCACTGACCAAGGGCATCCTGGGCTTCGTGTTTACCCTGACAGTGCCTTCTGAGCG

GGGCCTGTCTTGCATCAGCGAGGCAGACGCAACCACACCAGAGTCCGCCAATCTGGGCGAGGAGATCCTGT

CTCAGCTGTACCTGTGGCCCCGGGTGACATATCACTCCCCTTCTTACGCCTATCACCAGTTCGAGCGGAGAG

CCAAGTACAAGAGACACTTCCCAGGCTTTGGCCAGTCTCTGCTGTTCGGCTACCCCGTGTACGTGTTCGGCG

ATTGCGTGCAGGGCGACTGGGATGCCATCCGGTTTAGATACTGCGCACCACCTGGATATGCACTGCTGAGG

TGTAACGACACCAATTATTCCGCCCTGCTGGCAGTGGGCGCCCTGGAGGGCCCTCGCAATCAGGATTGGCT

GGGCGTGCCAAGGCAGCTGGTGACACGCATGCAGGCCATCCAGAACGCAGGCCTGTGCACCCTGGTGGCA

ATGCTGGAGGAGACAATCTTCTGGCTGCAGGCCTTTCTGATGGCCCTGACCGACAGCGGCCCCAAGACAAA

CATCATCGTGGATTCCCAGTACGTGATGGGCATCTCCAAGCCTTCTTTCCAGGAGTTTGTGGACTGGGAGAA

CGTGAGCCCAGAGCTGAATTCCACCGATCAGCCATTCTGGCAGGCAGGAATCCTGGCAAGGAACCTGGTGC
```

```
CTATGGTGGCCACAGTGCAGGGCCAGAATCTGAAGTACCAGGGCCAGAGCCTGGTCATCAGCGCCTCCATC

ATCGTGTTTAACCTGCTGGAGCTGGAGGGCGACTATCGGGACGATGGCAACGTGTGGGTGCACACCCCACT

GAGCCCCAGAACACTGAACGCCTGGGTGAAGGCCGTGGAGGAGAAGAAGGGCATCCCAGTGCACCTGGAG

CTGGCCTCCATGACCAATATGGAGCTGATGTCTAGCATCGTGCACCAGCAGGTGAGGACATACGGACCCGT

GTTCATGTGCCTGGGAGGCCTGCTGACCATGGTGGCAGGAGCCGTGTGGCTGACAGTGCGGGTGCTGGAGC

TGTTCAGAGCCGCCCAGCTGGCCAACGATGTGGTGCTGCAGATCATGGAGCTGTGCGGAGCAGCCTTTCGC

CAGGTGTGCCACACCACAGTGCCATGGCCCAATGCCTCCCTGACCCCCAAGTGGAACAATGAGACAACACA

GCCTCAGATCGCCAACTGTAGCGTGTACGACTTCTTCGTGTGGCTGCACTACTATAGCGTGAGGGATACCCT

GTGGCCCCGCGTGACATACCACATGAATAAGTACGCCTATCACATGCTGGAGAGGCGCGCCAAGTATAAG

AGAGGCCCTGGCCCAGGCGCAAAGTTTGTGGCAGCATGGACCCTGAAGGCCGCCGCCGGCCCCGGCCCCG

GCCAGTATATCAAGGCTAACAGTAAGTTCATTGGAATCACAGAGCTGGGACCCGGACCTGGATAATGAGTT

TAAACTCCCATTTAAATGTGAGGGTTAATGCTTCGAGCAGACATGATAAGATACATTGATGAGTTTGGACA

AACCACAACTAGAATGCAGTGAAAAAAATGCTTTATTTGTGAAATTTGTGATGCTATTGCTTTATTTGTAAC

CATTATAAGCTGCAATAAACAAGTTAACAACAACAATTGCATTCATTTTATGTTTCAGGTTCAGGGGAGA

TGTGGGAGGTTTTTTAAAGCAAGTAAAACCTCTACAAATGTGGTAAAATAACTATAACGGTCCTAAGGTAG

CGAGTGAGTAGTGTTCTGGGGCGGGGAGGACCTGCATGAGGGCCAGAATAACTGAAATCTGTGCTTTTCT

GTGTGTTGCAGCAGCATGAGCGGAAGCGGCTCCTTTGAGGGAGGGGTATTCAGCCCTTATCTGACGGGGCG

TCTCCCCTCCTGGGCGGGAGTGCGTCAGAATGTGATGGGATCCACGGTGGACGGCCGGCCCGTGCAGCCCG

CGAACTCTTCAACCCTGACCTATGCAACCCTGAGCTCTTCGTCGTTGGACGCAGCTGCCGCCGCAGCTGCTG

CATCTGCCGCCAGCGCCGTGCGCGAATGGCCATGGGCGCCGGCTACTACGGCACTCTGGTGGCCAACTCG

AGTTCCACCAATAATCCCGCCAGCCTGAACGAGGAGAAGCTGTTGCTGCTGATGGCCCAGCTCGAGGCCTT

GACCCAGCGCCTGGGCGAGCTGACCCAGCAGGTGGCTCAGCTGCAGGAGCAGACGCGGGCCGCGGTTGCC

ACGGTGAAATCCAAATAAAAAATGAATCAATAAATAAACGGAGACGGTTGTTGATTTTAACACAGAGTCTG

AATCTTTATTTGATTTTTCGCGCGCGGTAGGCCCTGGACCACCGGTCTCGATCATTGAGCACCCGGTGGATC

TTTTCCAGGACCCGGTAGAGGTGGGCTTGGATGTTGAGGTACATGGGCATGAGCCCGTCCCGGGGGTGGAG

GTAGCTCCATTGCAGGGCCTCGTGCTCGGGGGTGGTGTTGTAAATCACCCAGTCATAGCAGGGGCGCAGGG

CATGGTGTTGCACAATATCTTTGAGGAGGAGACTGATGGCCACGGGCAGCCCTTTGGTGTAGGTGTTTACA

AATCTGTTGAGCTGGGAGGGATGCATGCGGGGGGAGATGAGGTGCATCTTGGCCTGGATCTTGAGATTGGC

GATGTTACCGCCCAGATCCCGCCTGGGGTTCATGTTGTGCAGGACCACCAGCACGGTGTATCCGGTGCACT

TGGGGAATTTATCATGCAACTTGGAAGGGAAGGCGTGAAAGAATTTGGCGACGCCTTTGTGCCCGCCCAGG

TTTTCCATGCACTCATCCATGATGATGGCGATGGGCCCGTGGGCGGCGGCCTGGGCAAAGACGTTTCGGGG

GTCGGACACATCATAGTTGTGGTCCTGGGTGAGGTCATCATAGGCCATTTTAATGAATTTGGGGCGGAGGG

TGCCGGACTGGGGGACAAAGGTACCCTCGATCCCGGGGGCGTAGTTCCCCTCACAGATCTGCATCTCCCAG

GCTTTGAGCTCGGAGGGGGGATCATGTCCACCTGCGGGCGATAAAGAACACGGTTTCCGGGGCGGGGG

AGATGAGCTGGGCCGAAAGCAAGTTCCGGAGCAGCTGGGACTTGCCGCAGCCGGTGGGGCCGTAGATGAC

CCCGATGACCGGCTGCAGGTGGTAGTTGAGGGAGAGACAGCTGCCGTCCTCCCGGAGGAGGGGGCCACC

TCGTTCATCATCTCGCGCACGTGCATGTTCTCGCGCACCAGTTCCGCCAGGAGGCGCTCTCCCCCCAGGGAT

AGGAGCTCCTGGAGCGAGGCGAAGTTTTTCAGCGGCTTGAGTCCGTCGGCCATGGGCATTTTGGAGAGGGT

TTGTTGCAAGAGTTCCAGGCGGTCCCAGAGCTCGGTGATGTGCTCTACGGCATCTCGATCCAGCAGACCTC

CTCGTTTCGCGGGTTGGGACGGCTGCGGGAGTAGGGCACCAGACGATGGGCGTCCAGCGCAGCCAGGGTC
```

```
CGGTCCTTCCAGGGTCGCAGCGTCCGCGTCAGGGTGGTCTCCGTCACGGTGAAGGGGTGCGCGCCGGGCTG

GGCGCTTGCGAGGGTGCGCTTCAGGCTCATCCGGCTGGTCGAAAACCGCTCCCGATCGGCGCCCTGCGCGT

CGGCCAGGTAGCAATTGACCATGAGTTCGTAGTTGAGCGCCTCGGCCGCGTGGCCTTTGGCGCGGAGCTTA

CCTTTGGAAGTCTGCCCGCAGGCGGGACAGAGGAGGGACTTGAGGGCGTAGAGCTTGGGGGCGAGGAAGA

CGGACTCGGGGGCGTAGGCGTCCGCGCCGCAGTGGGCGCAGACGGTCTCGCACTCCACGAGCCAGGTGAG

GTCGGGCTGGTCGGGGTCAAAAACCAGTTTCCCGCCGTTCTTTTTGATGCGTTTCTTACCTTTGGTCTCCATG

AGCTCGTGTCCCCGCTGGGTGACAAAGAGGCTGTCCGTGTCCCCGTAGACCGACTTTATGGGCCGGTCCTC

GAGCGGTGTGCCGCGGTCCTCCTCGTAGAGGAACCCCGCCCACTCCGAGACGAAAGCCCGGGTCCAGGCC

AGCACGAAGGAGGCCACGTGGGACGGGTAGCGGTCGTTGTCCACCAGCGGGTCCACCTTTTCCAGGGTATG

CAAACACATGTCCCCCTCGTCCACATCCAGGAAGGTGATTGGCTTGTAAGTGTAGGCCACGTGACCGGGGG

TCCCGGCCGGGGGGGTATAAAAGGGTGCGGGTCCCTGCTCGTCCTCACTGTCTTCCGGATCGCTGTCCAGG

AGCGCCAGCTGTTGGGGTAGGTATTCCCTCTCGAAGGCGGGCATGACCTCGGCACTCAGGTTGTCAGTTTCT

AGAAACGAGGAGGATTTGATATTGACGGTGCCGGCGGAGATGCCTTTCAAGAGCCCCTCGTCCATCTGGTC

AGAAAAGACGATCTTTTTGTTGTCGAGCTTGGTGGCGAAGGAGCCGTAGAGGGCGTTGGAGAGGAGCTTGG

CGATGGAGCGCATGGTCTGGTTTTTTTCCTTGTCGGCGCGCTCCTTGGCGFCGATGTTGAGCTGCACGTACT

CGCGCGCCACGCACTTCCATTCGGGGAAGACGGTGGTCAGCTCGTCGGGCACGATTCTGACCTGCCAGCCC

CGATTATGCAGGGTGATGAGGTCCACACTGGTGGCCACCTCGCCGCGCAGGGGCTCATTAGTCCAGCAGAG

GCGTCCGCCCTTGCGCGAGCAGAAGGGGGGCAGGGGGTCCAGCATGACCTCGTCGGGGGGGTCGGCATCG

ATGGTGAAGATGCCGGGCAGGAGGTCGGGGTCAAAGTAGCTGATGGAAGTGGCCAGATCGTCCAGGGCAG

CTTGCCATTCGCGCACGGCCAGCGCGCGCTCGTAGGGACTGAGGGGCGTGCCCCAGGGCATGGGATGGGT

AAGCGCGGAGGCGTACATGCCGCAGATGTCGTAGACGTAGAGGGGCTCCTCGAGGATGCCGATGTAGGTG

GGGTAGCAGCGCCCCCCGCGGATGCTGGCGCGCACGTAGTCATACAGCTCGTGCGAGGGGGCGAGGAGCC

CCGGGCCCAGGTTGGTGCGACTGGGCTTTTCGGCGCGGTAGACGATCTGGCGGAAAATGGCATGCGAGTTG

GAGGAGATGGTGGGCCTTTGGAAGATGTTGAAGTGGGCGTGGGGCAGTCCGACCGAGTCGCGGATGAAGT

GGGCGTAGGAGTCTTGCAGCTTGGCGACGAGCTCGGCGGTGACTAGGACGTCCAGAGCGCAGTAGTCGAG

GGTCTCCTGGATGATGTCATACTTGAGCTGTCCCTTTTGTTTCCACAGCTCGCGGTTGAGAAGGAACTCTTC

GCGGTCCTTCCAGTACTCTTCGAGGGGGAACCCGTCCTGATCTGCACGGTAAGAGCCTAGCATGTAGAACT

GGTTGACGGCCTTGTAGGCGCAGCAGCCCTTCTCCACCGGGAGGGCGTAGGCCTGGGCGGCCTTGCGCAGG

GAGGTGTGCGTGAGGGCGAAAGTGTCCCTGACCATGACCTTGAGGAACTGGTGCTTGAAGTCGATATCGTC

GCAGCCCCCTGCTCCCAGAGCTGGAAGTCCGTGCGCTTCTTGTAGGCGGGGTTGGGCAAAGCGAAAGTAA

CATCGTTGAAGAGGATCTTGCCCGCGCGGGGCATAAAGTTGCGAGTGATGCGGAAAGGTTGGGGCACCTCG

GCCCGGTTGTTGATGACCTGGGCGGCGAGCACGATCTCGTCGAAGCCGTTGATGTTGTGGCCCACGATGTA

GAGTTCCACGAATCGCGGACGGCCCTTGACGTGGGGCAGTTTCTTGAGCTCCTCGTAGGTGAGCTCGTCGG

GGTCGCTGAGCCCGTGCTGCTCGAGCGCCCAGTCGGCGAGATGGGGGTTGGCGCGGAGGAAGGAAGTCCA

GAGATCCACGGCCAGGGCGGTTTGCAGACGGTCCCGGTACTGACGGAACTGCTGCCCGACGGCCATTTTTT

CGGGGGTGACGCAGTAGAAGGTGCGGGGGTCCCCGTGCCAGCGATCCCATTTGAGCTGGAGGGCGAGATC

GAGGGCGAGCTCGACGAGCCGGTCGTCCCCGGAGAGTTTCATGACCAGCATGAAGGGGACGAGCTGCTTG

CCGAAGGACCCCATCCAGGTGTAGGTTTCCACATCGTAGGTGAGGAAGAGCCTTTCGGTGCGAGGATGCGA

GCCGATGGGAAGAACTGGATCTCCTGCCACCAATTGGAGGAATGGCTGTTGATGTGATGGAAGTAGAAAT

GCCGACGGCGCGCCGAACACTCGTGCTTGTGTTTATACAAGCGGCCACAGTGCTCGCAACGCTGCACGGA

TGCACGTGCTGCACGAGCTGTACCTGAGTTCCTTTGACGAGGAATTTCAGTGGGAAGTGGAGTCGTGGCGC
```

```
CTGCATCTCGTGCTGTACTACGTCGTGGTGGTCGGCCTGGCCCTCTTCTGCCTCGATGGTGGTCATGCTGAC

GAGCCCGCGGGAGGCAGGTCCAGACCTCGGCGCGAGCGGGTCGGAGAGCGAGGACGAGGGCGCGCAG

GCCGGAGCTGTCCAGGGTCCTGAGACGCTGCGGAGTCAGGTCAGTGGGCAGCGGCGGCGCGCGGTTGACT

TGCAGGAGTTTTTCCAGGGCGCGCGGGAGGTCCAGATGGTACTTGATCTCCACCGCGCCATTGGTGGCGAC

GTCGATGGCTTGCAGGGTCCCGTGCCCCTGGGGTGTGACCACCGTCCCCGTTTCTTCTTGGGCGGCTGGGG

CGACGGGGGCGGTGCCTCTTCCATGGTTAGAAGCGGCGGCGAGGACGCGCGCCGGGCGGCAGGGGCGGCT

CGGGGCCCGGAGGCAGGGGCGGCAGGGGCACGTCGGCGCCGCGCGGGTAGGTTCTGGTACTGCGCCCG

GAGAAGACTGGCGTGAGCGACGACGCGACGGTTGACGTCCTGGATCTGACGCCTCTGGGTGAAGGCCACG

GGACCCGTGAGTTTGAACCTGAAAGAGAGTTCGACAGAATCAATCTCGGTATCGTTGACGGCGGCCTGCCG

CAGGTACTCTTGCACGTCGCCCGAGTTGTCCTGGTAGGCGATCTCGGTCATGAACTGCTCGATCTCCTCCTC

TTGAAGGTCTCCGCGGCCGGCGCGCTCCACGGTGGCCGCGAGGTCGTTGGAGATGCGGCCCATGAGCTGCG

AGAAGGCGTTCATGCCCGCCTCGTTCCAGACGCGGCTGTAGACCACGACGCCCTCGGGATCGCGGGCGCGC

ATGACCACCTGGGCGAGGTTGAGCTCCACGTGGCGCGTGAAGACCGCGTAGTTGCAGAGGCGCTGGTAGA

GGTAGTTGAGCGTGGTGGCGATGTGCTCGGTGACGAAGAAATACATGATCCAGCGGCGGAGCGGCATCTC

GCTGACGTCGCCCAGCGCCTCCAAACGTTCCATGGCCTCGTAAAAGTCCACGGCGAAGTTGAAAAACTGGG

AGTTGCGCGCCGAGACGGTCAACTCCTCCTCCAGAAGACGGATGAGCTCGGCGATGGTGGCGCGCACCTCG

CGCTCGAAGGCCCCCGGAGTTCCTCCACTTCCTCTTCTTCCTCCTCCACTAACATCTCTTCTACTTCCTCCT

CAGGCGGCAGTGGTGGCGGGGGAGGGGGCCTGCGTCGCCGGCGGCGCACGGGCAGACGGTCGATGAAGC

GCTCGATGGTCTCGCCGCGCCGGCGTCGCATGGTCTCGGTGACGGCGCGCCCGTCCTCGCGGGGCCGCAGC

GTGAAGACGCCGCCGCGCATCTCCAGGTGGCCGGGGGGGTCCCCGTTGGGCAGGGAGAGGGCGCTGACGA

TGCATCTTATCAATTGCCCCGTAGGGACTCCGCGCAAGGACCTGAGCGTCTCGAGATCCACGGGATCTGAA

AACCGCTGAACGAAGGCTTCGAGCCAGTCGCAGTCGCAAGGTAGGCTGAGCACGGTTTCTTCTGGCGGGTC

ATGTTGGTTGGGAGCGGGCGGGCGATGCTGCTGGTGATGAAGTTGAAATAGGCGGTTCTGAGACGGCGG

ATGGTGGCGAGGAGCACCAGGTCTTTGGGCCCGGCTTGCTGGATGCGCAGACGGTCGGCCATGCCCCAGGC

GTGGTCCTGACACCTGGCCAGGTCCTTGTAGTAGTCCTGCATGAGCCGCTCCACGGGCACCTCCTCCTCGCC

CGCGCGGCCGTGCATGCGCGTGAGCCCGAAGCCGCGCTGGGGCTGGACGAGCGCCAGGTCGGCGACGACG

CGCTCGGCGAGGATGGCTTGCTGGATCTGGGTGAGGGTGGTCTGGAAGTCATCAAAGTCGACGAAGCGGTG

GTAGGCTCCGGTGTTGATGGTGTAGGAGCAGTTGGCCATGACGGACCAGTTGACGGTCTGGTGGCCCGGAC

GCACGAGCTCGTGGTACTTGAGGCGCGAGTAGGCGCGCGTGTCGAAGATGTAGTCGTTGCAGGTGCGCACC

AGGTACTGGTAGCCGATGAGGAAGTGCGGCGGCGGCTGGCGGTAGAGCGGCCATCGCTCGGTGGCGGGGG

CGCCGGGCGCGAGGTCCTCGAGCATGGTGCGGTGGTAGCCGTAGATGTACCTGGACATCCAGGTGATGCCG

GCGGCGGTGGTGGAGGCGCGCGGGAACTCGCGGACGCGGTTCCAGATGTTGCGCAGCGGCAGGAAGTAGT

TCATGGTGGGCACGGTCTGGCCCGTGAGGCGCGCAGTCGTGGATGCTCTATACGGGCAAAAACGAAAG

CGGTCAGCGGCTCGACTCCGTGGCCTGGAGGCTAAGCGAACGGGTTGGGCTGCGCGTGTACCCCGGTTCGA

ATCTCGAATCAGGCTGGAGCCGCAGCTAACGTGGTATTGGCACTCCCGTCTCGACCCAAGCCTGCACCAAC

CCTCCAGGATACGGAGGCGGGTCGTTTTGCAACTTTTTTTTGGAGGCCGGATGAGACTAGTAAGCGCGGAA

AGCGGCCGACCGCGATGGCTCGCTGCCGTAGTCTGGAGAAGAATCGCCAGGGTTGCGTTGCGGTGTGCCC

GGTTCGAGGCCGGCCGGATTCCGCGGCTAACGAGGGCGTGGCTGCCCCGTCGTTTCCAAGACCCCATAGCC

AGCCGACTTCTCCAGTTACGGAGCGAGCCCCTCTTTTGTTTTGTTTGTTTTTGCCAGATGCATCCCGTACTGC

GGCAGATGCGCCCCCACCACCCTCCACCGCAACAACAGCCCCCTCCACAGCCGGCGCTTCTGCCCCCGCCC
```

-continued

```
CAGCAGCAACTTCCAGCCACGACCGCCGCGGCCGCCGTGAGCGGGGCTGGACAGAGTTATGATCACCAGC

TGGCCTTGGAAGAGGGCGAGGGGCTGGCGCGCCTGGGGGCGTCGTCGCCGGAGCGGCACCCGCGCGTGCA

GATGAAAAGGGACGCTCGCGAGGCCTACGTGCCCAAGCAGAACCTGTTCAGAGACAGGAGCGGCGAGGAG

CCCGAGGAGATGCGCGCGGCCCGGTTCCACGCGGGGCGGGAGCTGCGGCGCGGCCTGGACCGAAAGAGGG

TGCTGAGGGACGAGGATTTCGAGGCGGACGAGCTGACGGGGATCAGCCCCGCGCGCGCACGTGGCCGC

GGCCAACCTGGTCACGGCGTACGAGCAGACCGTGAAGGAGGAGAGCAACTTCCAAAAATCCTTCAACAAC

CACGTGCGCACCCTGATCGCGCGCGAGGAGGTGACCCTGGGCCTGATGCACCTGTGGGACCTGCTGGAGGC

CATCGTGCAGAACCCCACCAGCAAGCCGCTGACGGCGCAGCTGTTCCTGGTGGTGCAGCATAGTCGGGACA

ACGAAGCGTTCAGGGAGGCGCTGCTGAATATCACCGAGCCCGAGGGCCGCTGGCTCCTGGACCTGGTGAA

CATTCTGCAGAGCATCGTGGTGCAGGAGCGCGGGCTGCCGCTGTCCGAGAAGCTGGCGGCCATCAACTTCT

CGGTGCTGAGTTTGGGCAAGTACTACGCTAGGAAGATCTACAAGACCCCGTACGTGCCCATAGACAAGGAG

GTGAAGATCGACGGGTTTTACATGCGCATGACCCTGAAAGTGCTGACCCTGAGCGACGATCTGGGGGTGTA

CCGCAACGACAGGATGCACCGTGCGGTGAGCGCCAGCAGGCGGCGCGAGCTGAGCGACCAGGAGCTGATG

CATAGTCTGCAGCGGGCCCTGACCGGGGCCGGGACCGAGGGGGAGAGCTACTTTGACATGGGCGCGGACC

TGCACTGGCAGCCCAGCCGCCGGGCCTTGGAGGCGGCGGCAGGACCCTACGTAGAAGAGGTGGACGATGA

GGTGGACGAGGAGGGCGAGTACCTGGAAGACTGATGGCGCGACCGTATTTTTGCTAGATGCAACAACAAC

AGCCACCTCCTGATCCCGCGATGCGGGCGGCGCTGCAGAGCCAGCCGTCCGGCATTAACTCCTCGGACGAT

TGGACCCAGGCCATGCAACGCATCATGGCGCTGACGACCCGCAACCCCGAAGCCTTTAGACAGCAGCCCCA

GGCCAACCGGCTCTCGGCCATCCTGGAGGCCGTGGTGCCCTCGCGCTCCAACCCCACGCACGAGAAGGTCC

TGGCCATCGTGAACGCGCTGGTGGAGAACAAGGCCATCCGCGGCGACGAGGCCGGCCTGGTGTACAACGC

GCTGCTGGAGCGCGTGGCCCGCTACAACAGCACCAACGTGCAGACCAACCTGGACCGCATGGTGACCGAC

GTGCGCGAGGCCGTGGCCCAGCGCGAGCGGTTCCACCGCGAGTCCAACCTGGGATCCATGGTGGCGCTGA

ACGCCTTCCTCAGCACCCAGCCCGCCAACGTGCCCCGGGGCCAGGAGGACTACACCAACTTCATCAGCGCC

CTGCGCCTGATGGTGACCGAGGTGCCCCAGAGCGAGGTGTACCAGTCCGGGCCGGACTACTTCTTCCAGAC

CAGTCGCCAGGGCTTGCAGACCGTGAACCTGAGCCAGGCTTTCAAGAACTTGCAGGGCCTGTGGGCGTGC

AGGCCCCGGTCGGGGACCGCGCGACGGTGTCGAGCCTGCTGACGCCGAACTCGCGCCTGCTGCTGCTGCTG

GTGGCCCCCTTCACGGACAGCGGCAGCATCAACCGCAACTCGTACCTGGGCTACCTGATTAACCTGTACCG

CGAGGCCATCGGCCAGGCGCACGTGGACGAGCAGACCTACCAGGAGATCACCCACGTGAGCCGCGCCCTG

GGCCAGGACGACCCGGGCAACCTGGAAGCCACCCTGAACTTTTTGCTGACCAACCGGTCGCAGAAGATCCC

GCCCCAGTACGCGCTCAGCACCGAGGAGGAGCGCATCCTGCGTTACGTGCAGCAGAGCGTGGGCCTGTTCC

TGATGCAGGAGGGGCCACCCCCAGCGCCGCGCTCGACATGACCGCGCGCAACATGGAGCCCAGCATGTA

CGCCAGCAACCGCCCGTTCATCAATAAACTGATGGACTACTTGCATCGGGCGGCCGCCATGAACTCTGACT

ATTTCACCAACGCCATCCTGAATCCCCACTGGCTCCCGCCGCCGGGGTTCTACACGGGCGAGTACGACATG

CCCGACCCCAATGACGGGTTCCTGTGGGACGATGTGGACAGCAGCGTGTTCTCCCCCCGACCGGGTGCTAA

CGAGCGCCCCTTGTGGAAGAAGGAAGGCAGCGACCGACGCCCGTCCTCGGCGCTGTCCGGCCGCGAGGGT

GCTGCCGCGGCGGTGCCGAGGCCGCCAGTCCTTTCCCGAGCTTGCCCTTCTCGCTGAACAGTATCCGCAGC

AGCGAGCTGGGCAGGATCACGCGCCCGCGCTTGCTGGGCGAAGAGGAGTACTTGAATGACTCGCTGTTGAG

ACCCGAGCGGGAGAAGAACTTCCCCAATAACGGGATAGAAAGCCTGGTGGACAAGATGAGCCGCTGGAAG

ACGTATGCGCAGGAGCACAGGGACGATCCCCGGGCGTCGCAGGGGGCCACGAGCCGGGGCAGCGCCGCCC

GTAAACGCCGGTGGCACGACAGGCAGCGGGACAGATGTGGGACGATGAGGACTCCGCCGACGACAGCA

GCGTGTTGGACTTGGGTGGGAGTGGTAACCCGTTCGCTCACCTGCGCCCCCGTATCGGGCGCATGATGTAA
```

-continued

```
GAGAAACCGAAAATAAATGATACTCACCAAGGCCATGGCGACCAGCGTGCGTTCGTTTCTTCTCTGTTGTT

GTTGTATCTAGTATGATGAGGCGTGCGTACCCGGAGGGTCCTCCTCCCTCGTACGAGAGCGTGATGCAGCA

GGCGATGGCGGCGGCGGCGATGCAGCCCCCGCTGGAGGCTCCTTACGTGCCCCCGCGGTACCTGGCGCCTA

CGGAGGGGCGGAACAGCATTCGTTACTCGGAGCTGGCACCCTTGTACGATACCACCCGGTTGTACCTGGTG

GACAACAAGTCGGCGGACATCGCCTCGCTGAACTACCAGAACGACCACAGCAACTTCCTGACCACCGTGGT

GCAGAACAATGACTTCACCCCCACGGAGGCCAGCACCCAGACCATCAACTTTGACGAGCGCTCGCGGTGG

GGCGGCCAGCTGAAAACCATCATGCACACCAACATGCCCAACGTGAACGAGTTCATGTACAGCAACAAGT

TCAAGGCGCGGGTGATGGTCTCCCGCAAGACCCCCAATGGGGTGACAGTGACAGAGGATTATGATGGTAGT

CAGGATGAGCTGAAGTATGAATGGGTGGAATTTGAGCTGCCCGAAGGCAACTTCTCGGTGACCATGACCAT

CGACCTGATGAACAACGCCATCATCGACAATTACTTGGCGGTGGGGCGGCAGAACGGGGTGCTGGAGAGC

GACATCGGCGTGAAGTTCGACACTAGGAACTTCAGGCTGGGCTGGGACCCCGTGACCGAGCTGGTCATGCC

CGGGGTGTACACCAACGAGGCTTTCCATCCCGATATTGTCTTGCTGCCCGGCTGCGGGGTGGACTTCACCG

AGAGCCGCCTCAGCAACCTGCTGGGCATTCGCAAGAGGCAGCCCTTCCAGGAAGGCTTCCAGATCATGTAC

GAGGATCTGGAGGGGGGCAACATCCCCGCGCTCCTGGATGTCGACGCCTATGAGAAAAGCAAGGAGGATG

CAGCAGCTGAAGCAACTGCAGCCGTAGCTACCGCCTCTACCGAGGTCAGGGGCGATAATTTTGCAAGCGCC

GCAGCAGTGGCAGCGGCCGAGGCGGCTGAAACCGAAAGTAAGATAGTCATTCAGCCGGTGGAGAAGGATA

GCAAGAACAGGAGCTACAACGTACTACCGGACAAGATAAACACCGCCTACCGCAGCTGGTACCTAGCCTA

CAACTATGGCGACCCCGAGAAGGGCGTGCGCTCCTGGACGCTGCTCACCACCTCGGACGTCACCTGCGGCG

TGGAGCAAGTCTACTGGTCGCTGCCCGACATGATGCAAGACCCGGTCACCTTCCGCTCCACGCGTCAAGTT

AGCAACTACCCGGTGGTGGGCGCCGAGCTCCTGCCCGTCTACTCCAAGAGCTTCTTCAACGAGCAGGCCGT

CTACTCGCAGCAGCTGCGCGCCTTCACCTCGCTTACGCACGTCTTCAACCGCTTCCCCGAGAACCAGATCCT

CGTCCGCCCGCCCGCGCCCACCATTACCACCGTCAGTGAAAACGTTCCTGCTCTCACAGATCACGGGACCC

TGCCGCTGCGCAGCAGTATCCGGGGAGTCCAGCGCGTGACCGTTACTGACGCCAGACGCCGCACCTGCCCC

TACGTCTACAAGGCCCTGGGCATAGTCGCGCCGCGCGTCCTCTCGAGCCGCACCTTCTAAATGTCCATTCTC

ATCTCGCCCAGTAATAACACCGGTTGGGGCCTGCGCGCGCCCAGCAAGATGTACGGAGGCGCTCGCCAACG

CTCCACGCAACACCCCGTGCGCGTGCGCGGGCACTTCCGCGCTCCCTGGGGCGCCCTCAAGGGCCGCGTGC

GGTCGCGCACCACCGTCGACGACGTGATCGACCAGGTGGTGGCCGACGCGCGCAACTACACCCCCGCCGCC

GCGCCCGTCTCCACCGTGGACGCCGTCATCGACAGCGTGGTGGCCGACGCGCGCCGGTACGCCCGCGCCAA

GAGCCGGCGGCGGCGCATCGCCCGGCGGCACCGGAGCACCCCCGCCATGCGCGCGGCGCGAGCCTTGCTG

CGCAGGGCCAGGCGCACGGGACGCAGGGCCATGCTCAGGGCGGCCAGACGCGCGGCTTCAGGCGCCAGCG

CCGGCAGGACCCGGAGACGCGCGGCCACGGCGGCGGCAGCGGCCATCGCCAGCATGTCCCGCCCGCGGCG

AGGGAACGTGTACTGGGTGCGCGACGCCGCCACCGGTGTGCGCGTGCCCGTGCGCACCCGCCCCCCTCGCA

CTTGAAGATGTTCACTTCGCGATGTTGATGTGTCCCAGCGGCGAGGAGGATGTCCAAGCGCAAATTCAAGG

AAGAGATGCTCCAGGTCATCGCGCCTGAGATCTACGGCCCTGCGGTGGTGAAGGAGGAAAGAAAGCCCCG

CAAAATCAAGCGGGTCAAAAAGGACAAAAAGGAAGAAGAAAGTGATGTGGACGGATTGGTGGAGTTTGTG

CGCGAGTTCGCCCCCCGGCGGCGCGTGCAGTGGCGCGGGCGGAAGGTGCAACCGGTGCTGAGACCCGGCA

CCACCGTGGTCTTCACGCCCGGCGAGCGCTCCGGCACCGCTTCCAAGCGCTCCTACGACGAGGTGTACGGG

GATGATGATATTCTGGAGCAGGCGGCCGAGCGCCTGGGCGAGTTTGCTTACGGCAAGCGCAGCCGTTCCGC

ACCGAAGGAAGAGGCGGTGTCCATCCCGCTGGACCACGGCAACCCCACGCCGAGCCTCAAGCCCGTGACC

TTGCAGCAGGTGCTGCCGACCGCGGCGCCGCGCCGGGGGTTCAAGCGCGAGGGCGAGGATCTGTACCCCA
```

-continued

```
CCATGCAGCTGATGGTGCCCAAGCGCCAGAAGCTGGAAGACGTGCTGGAGACCATGAAGGTGGACCCGGA

CGTGCAGCCCGAGGTCAAGGTGCGGCCCATCAAGCAGGTGGCCCCGGGCCTGGGCGTGCAGACCGTGGAC

ATCAAGATTCCCACGGAGCCCATGGAAACGCAGACCGAGCCCATGATCAAGCCCAGCACCAGCACCATGG

AGGTGCAGACGGATCCCTGGATGCCATCGGCTCCTAGTCGAAGACCCCGGCGCAAGTACGGCGCGGCCAG

CCTGCTGATGCCCAACTACGCGCTGCATCCTTCCATCATCCCCACGCCGGGCTACCGCGGCACGCGCTTCTA

CCGCGGTCATACCAGCAGCCGCCGCCGCAAGACCACCACTCGCCGCCGCCGTCGCCGCACCGCCGCTGCAA

CCACCCCTGCCGCCCTGGTGCGGAGAGTGTACCGCCGCGGCCGCGCACCTCTGACCCTGCCGCGCGCGCGC

TACCACCCGAGCATCGCCATTTAAACTTTCGCCTGCTTTGCAGATCAATGGCCCTCACATGCCGCCTTCGCG

TTCCCATTACGGGCTACCGAGGAAGAAAACCGCGCCGTAGAAGGCTGGCGGGGAACGGGATGCGTCGCCA

CCACCACCGGCGGCGGCGCGCCATCAGCAAGCGGTTGGGGGGAGGCTTCCTGCCCGCGCTGATCCCCATCA

TCGCCGCGGCGATCGGGGCGATCCCCGGCATTGCTTCCGTGGCGGTGCAGGCCTCTCAGCGCCACTGAGAC

ACACTTGGAAACATCTTGTAATAAACCAATGGACTCTGACGCTCCTGGTCCTGTGATGTGTTTTCGTAGACA

GATGGAAGACATCAATTTTTCGTCCCTGGCTCCGCGACACGGCACGCGGCCGTTCATGGGCACCTGGAGCG

ACATCGGCACCAGCCAACTGAACGGGGGCGCCTTCAATTGGAGCAGTCTCTGGAGCGGGCTTAAGAATTTC

GGGTCCACGCTTAAAACCTATGGCAGCAAGGCGTGGAACAGCACCACAGGGCAGGCGCTGAGGGATAAGC

TGAAAGAGCAGAACTTCCAGCAGAAGGTGGTCGATGGGCTCGCCTCGGGCATCAACGGGGTGGTGGACCT

GGCCAACCAGGCCGTGCAGCGGCAGATCAACAGCCGCCTGGACCCGGTGCCGCCCGCCGGCTCCGTGGAG

ATGCCGCAGGTGGAGGAGGAGCTGCCTCCCCTGGACAAGCGGGGCGAGAAGCGACCCCGCCCCGATGCGG

AGCAGACGCTGCTGACGCACACGGACGAGCCGCCCCCGTACGAGGAGGCGGTGAAACTGGGTCTGCCCAC

CACGCGGCCCATCGCGCCCCTGGCCACCGGGGTGCTGAAACCCGAAAAGCCCGCGACCCTGGACTTGCCTC

CTCCCCAGCCTTCCCGCCCCTCTACAGTGGCTAAGCCCCTGCCGCCGGTGGCCGTGCCCGCGCGCGACCC

GGGGGCACCGCCCGCCCTCATGCGAACTGGCAGAGCACTCTGAACAGCATCGTGGGTCTGGGAGTGCAGA

GTGTGAAGCGCCGCCGCTGCTATTAAACCTACCGTAGCGCTTAACTTGCTTGTCTGTGTGTATGTATTAT

GTCGCCGCCGCCGCTGTCCACCAGAAGGAGGAGTGAAGAGGCGCGTCGCCGAGTTGCAAGATGGCCACCC

CATCGATGCTGCCCCAGTGGGCGTACATGCACATCGCCGACAGGACGCTTCGGAGTACCTGAGTCCGGGT

CTGGTGCAGTTTGCCCGCGCCACAGACACCTACTTCAGTCTGGGGAACAAGTTTAGGAACCCCACGGTGGC

GCCCACGCACGATGTGACCACCGACCGCAGCCAGCGGCTGACGCTGCGCTTCGTGCCCGTGGACCGCGAGG

ACAACACCTACTCGTACAAAGTGCGCTACACGCTGGCCGTGGGCGACAACCGCGTGCTGGACATGGCCAGC

ACCTACTTTGACATCCGCGGCGTGCTGGATCGGGGCCCTAGCTTCAAACCCTACTCCGGCACCGCCTACAA

CAGTCTGGCCCCCAAGGGAGCACCCAACACTTGTCAGTGGACATATAAAGCCGATGGTGAAACTGCCACA

GAAAAAACCTATACATATGGAAATGCACCCGTGCAGGGCATTAACATCACAAAAGATGGTATTCAACTTGG

AACTGACACCGATGATCAGCCAATCTACGCAGATAAAACCTATCAGCCTGAACCTCAAGTGGGTGATGCTG

AATGGCATGACATCACTGGTACTGATGAAAAGTATGGAGGCAGAGCTCTTAAGCCTGATACCAAAATGAA

GCCTTGTTATGGTTCTTTTGCCAAGCCTACTAATAAAGAAGGAGGTCAGGCAAATGTGAAAACAGGAACAG

GCACTACTAAAGAATATGACATAGACATGGCTTTCTTTGACAACAGAAGTGCGGCTGCTGCTGGCCTAGCT

CCAGAAATTGTTTTGTATACTGAAAATGTGGATTTGGAAACTCCAGATACCCATATTGTATACAAAGCAGG

CACAGATGACAGCAGCTCTTCTATTAATTTGGGTCAGCAAGCCATGCCCAACAGACCTAACTACATTGGTTT

CAGAGACAACTTTATCGGGCTCATGTACTACAACAGCACTGGCAATATGGGGGTGCTGGCCGGTCAGGCTT

CTCAGCTGAATGCTGTGGTTGACTTGCAAGACAGAAACACCGAGCTGTCCTACCAGCTCTTGCTTGACTCTC

TGGGTGACAGAACCCGGTATTTCAGTATGTGGAATCAGGCGGTGGACAGCTATGATCCTGATGTGCGCATT

ATTGAAAATCATGGTGTGGAGGATGAACTTCCCAACTATTGTTTCCCTCTGGATGCTGTTGGCAGAACAGAT
```

```
ACTTATCAGGGAATTAAGGCTAATGGAACTGATCAAACCACATGGACCAAAGATGACAGTGTCAATGATGC

TAATGAGATAGGCAAGGGTAATCCATTCGCCATGGAAATCAACATCCAAGCCAACCTGTGGAGGAACTTCC

TCTACGCCAACGTGGCCCTGTACCTGCCCGACTCTTACAAGTACACGCCGGCCAATGTTACCCTGCCCACCA

ACACCAACACCTACGATTACATGAACGGCCGGGTGGTGGCGCCCTCGCTGGTGGACTCCTACATCAACATC

GGGGCGCGCTGGTCGCTGGATCCCATGGACAACGTGAACCCCTTCAACCACCACCGCAATGCGGGGCTGCG

CTACCGCTCCATGCTCCTGGGCAACGGGCGCTACGTGCCCTTCCACATCCAGGTGCCCCAGAAATTTTCGC

CATCAAGAGCCTCCTGCTCCTGCCCGGGTCCTACACCTACGAGTGGAACTTCCGCAAGGACGTCAACATGA

TCCTGCAGAGCTCCCTCGGCAACGACCTGCGCACGGACGGGGCCTCCATCTCCTTCACCAGCATCAACCTCT

ACGCCACCTTCTTCCCCATGGCGCACAACACGGCCTCCACGCTCGAGGCCATGCTGCGCAACGACACCAAC

GACCAGTCCTTCAACGACTACCTCTCGGCGGCCAACATGCTCTACCCCATCCCGGCCAACGCCACCAACGT

GCCCATCTCCATCCCCTCGCGCAACTGGGCCGCCTTCCGCGGCTGGTCCTTCACGCGTCTCAAGACCAAGGA

GACGCCCTCGCTGGGCTCCGGGTTCGACCCCTACTTCGTCTACTCGGGCTCCATCCCCTACCTCGACGGCAC

CTTCTACCTCAACCACACCTTCAAGAAGGTCTCCATCACCTTCGACTCCTCCGTCAGCTGGCCCGGCAACGA

CCGGCTCCTGACGCCCAACGAGTTCGAAATCAAGCGCACCGTCGACGGCGAGGGCTACAACGTGGCCCAG

TGCAACATGACCAAGGACTGGTTCCTGGTCCAGATGCTGGCCCACTACAACATCGGCTACCAGGGCTTCTA

CGTGCCCGAGGGCTACAAGGACCGCATGTACTCCTTCTTCCGCAACTTCCAGCCCATGAGCCGCCAGGTGG

TGGACGAGGTCAACTACAAGGACTACCAGGCCGTCACCCTGGCCTACCAGCACAACAACTCGGGCTTCGTC

GGCTACCTCGCGCCCACCATGCGCCAGGGCCAGCCCTACCCCGCCAACTACCCCTACCCGCTCATCGGCAA

GAGCGCCGTCACCAGCGTCACCCAGAAAAAGTTCCTCTGCGACAGGGTCATGTGGCGCATCCCCTTCTCCA

GCAACTTCATGTCCATGGGCGCGCTCACCGACCTCGGCCAGAACATGCTCTATGCCAACTCCGCCCACGCG

CTAGACATGAATTTCGAAGTCGACCCCATGGATGAGTCCACCCTTCTCTATGTTGTCTTCGAAGTCTTCGAC

GTCGTCCGAGTGCACCAGCCCCACCGCGGCGTCATCGAGGCCGTCTACCTGCGCACCCCCTTCTCGGCCGG

TAACGCCACCACCTAAGCTCTTGCTTCTTGCAAGCCATGGCCGCGGGCTCCGGCGAGCAGGAGCTCAGGGC

CATCATCCGCGACCTGGGCTGCGGGCCTACTTCCTGGGCACCTTCGATAAGCGCTTCCCGGGATTCATGGC

CCCGCACAAGCTGGCCTGCGCCATCGTCAACACGGCCGGCCGCGAGACCGGGGGCGAGCACTGGCTGGCC

TTCGCCTGGAACCCGCGCTCGAACACCTGCTACCTCTTCGACCCCTTCGGGTTCTCGGACGAGCGCCTCAAG

CAGATCTACCAGTTCGAGTACGAGGGCCTGCTGCGCCGCAGCGCCCTGGCCACCGAGGACCGCTGCGTCAC

CCTGGAAAAGTCCACCCAGACCGTGCAGGGTCCGCGCTCGGCCGCCTGCGGGCTCTTCTGCTGCATGTTCCT

GCACGCCTTCGTGCACTGGCCCGACCGCCCCATGGACAAGAACCCCACCATGAACTTGCTGACGGGGGTGC

CCAACGGCATGCTCCAGTCGCCCCAGGTGGAACCCACCCTGCGCCGCAACCAGGAGGCGCTCTACCGCTTC

CTCAACTCCCACTCCGCCTACTTTCGCTCCCACCGCGCGCGCATCGAGAAGGCCACCGCCTTCGACCGCATG

AATCAAGACATGTAAACCGTGTGTGTATGTTAAATGTCTTTAATAAACAGCACTTTCATGTTACACATGCAT

CTGAGATGATTTATTTAGAAATCGAAAGGGTTCTGCCGGGTCTCGGCATGGCCCGCGGGCAGGGACACGTT

GCGGAACTGGTACTTGGCCAGCCACTTGAACTCGGGGATCAGCAGTTTGGGCAGCGGGTGTCGGGAAG

GAGTCGGTCCACAGCTTCCGCGTCAGTTGCAGGGCGCCCAGCAGGTCGGGCGCGGAGATCTTGAAATCGCA

GTTGGGACCCGCGTTCTGCGCGCGGGAGTTGCGGTACACGGGTTGCAGCACTGGAACACCATCAGGGCCG

GGTGCTTCACGCTCGCCAGCACCGTCGCGTCGGTGATGCTCTCCACGTCGAGGTCCTCGGCGTTGGCCATCC

CGAAGGGGGTCATCTTGCAGGTCTGCCTTCCCATGGTGGGCACGCACCCGGGCTTGTGGTTGCAATCGCAG

TGCAGGGGATCAGCATCATCTGGGCCTGGTCGGCGTTCATCCCCGGGTACATGGCCTTCATGAAAGCCTC

CAATTGCCTGAACGCCTGCTGGGCCTTGGCTCCCTCGGTGAAGAAGACCCCGCAGGACTTGCTAGAGAACT
```

-continued

```
GGTTGGTGGCGCACCCGGCGTCGTGCACGCAGCAGCGCGCGTCGTTGTTGGCCAGCTGCACCACGCTGCGC
CCCCAGCGGTTCTGGGTGATCTTGGCCCGGTCGGGGTTCTCCTTCAGCGCGCGCTGCCCGTTCTCGCTCGCC
ACATCCATCTCGATCATGTGCTCCTTCTGGATCATGGTGGTCCCGTGCAGGCACCGCAGCTTGCCCTCGGCC
TCGGTGCACCCGTGCAGCCACAGCGCGCACCCGGTGCACTCCCAGTTCTTGTGGGCGATCTGGGAATGCGC
GTGCACGAAGCCCTGCAGGAAGCGGCCCATCATGGTGGTCAGGGTCTTGTTGCTAGTGAAGGTCAGCGGAA
TGCCGCGGTGCTCCTCGTTGATGTACAGGTGGCAGATGCGGCGGTACACCTCGCCCTGCTCGGGCATCAGC
TGGAAGTTGGCTTTCAGGTCGGTCTCCACGCGGTAGCGGTCCATCAGCATAGTCATGATTTCCATACCCTTC
TCCCAGGCCGAGACGATGGGCAGGCTCATAGGGTTCTTCACCATCATCTTAGCGCTAGCAGCCGCGGCCAG
GGGGTCGCTCTCGTCCAGGGTCTCAAAGCTCCGCTTGCCGTCCTTCTCGGTGATCCGCACCGGGGGGTAGCT
GAAGCCCACGGCCGCCAGCTCCTCCTCGGCCTGTCTTTCGTCCTCGCTGTCCTGGCTGACGTCCTGCAGGAC
CACATGCTTGGTCTTGCGGGGTTTCTTCTTGGGCGGCAGCGGCGGCGGAGATGTTGGAGATGGCGAGGGGG
AGCGCGAGTTCTCGCTCACCACTACTATCTCTTCCTCTTCTTGGTCCGAGGCCACGCGGCGGTAGGTATGTC
TCTTCGGGGGCAGAGGCGGAGGCGACGGGCTCTCGCCGCCGCGACTTGGCGGATGGCTGGCAGAGCCCCTT
CCGCGTTCGGGGGTGCGCTCCCGGCGGCGCTCTGACTGACTTCCTCCGCGGCCGGCCATTGTGTTCTCCTAG
GGAGGAACAACAAGCATGGAGACTCAGCCATCGCCAACCTCGCCATCTGCCCCCACCGCCGACGAGAAGC
AGCAGCAGCAGAATGAAAGCTTAACCGCCCCGCCGCCCAGCCCCGCCACCTCCGACGCGGCCGTCCCAGA
CATGCAAGAGATGGAGGAATCCATCGAGATTGACCTGGGCTATGTGACGCCCGCGGAGCACGAGGAGGAG
CTGGCAGTGCGCTTTTCACAAGAAGAGATACACCAAGAACAGCCAGAGCAGGAAGCAGAGAATGAGCAGA
GTCAGGCTGGGCTCGAGCATGACGGCGACTACCTCCACCTGAGCGGGGGGGAGGACGCGCTCATCAAGCA
TCTGGCCCGGCAGGCCACCATCGTCAAGGATGCGCTGCTCGACCGCACCGAGGTGCCCCTCAGCGTGGAGG
AGCTCAGCCGCGCCTACGAGTTGAACCTCTTCTCGCCGCGCGTGCCCCCCAAGCGCCAGCCCAATGGCACC
TGCGAGCCCAACCCGCGCCTCAACTTCTACCCGGTCTTCGCGGTGCCCGAGGCCCTGGCCACCTACCACATC
TTTTTCAAGAACCAAAAGATCCCCGTCTCCTGCCGCGCCAACCGCACCCGCGCCGACGCCCTTTTCAACCTG
GGTCCCGGCGCCCGCCTACCTGATATCGCCTCCTTGGAAGAGGTTCCCAAGATCTTCGAGGGTCTGGGCAG
CGACGAGACTCGGGCCGCGAACGCTCTGCAAGGAGAAGGAGGAGAGCATGAGCACCACAGCGCCCTGGTC
GAGTTGGAAGGCGACAACGCGCGGCTGGCGGTGCTCAAACGCACGGTCGAGCTGACCCATTCGCCTACCC
GGCTCTGAACCTGCCCCCCAAAGTCATGAGCGCGGTCATGGACCAGGTGCTCATCAAGCGCGCGTCGCCCA
TCTCCGAGGACGAGGGCATGCAAGACTCCGAGGAGGGCAAGCCCGTGGTCAGCGACGAGCAGCTGGCCCG
GTGGCTGGGTCCTAATGCTAGTCCCCAGAGTTTGGAAGAGCGGCGCAAACTCATGATGGCCGTGGTCCTGG
TGACCGTGGAGCTGGAGTGCCTGCGCCGCTTCTTCGCCGACGCGGAGACCCTGCGCAAGGTCGAGGAGAAC
CTGCACTACCTCTTCAGGCACGGGTTCGTGCGCCAGGCCTGCAAGATCTCCAACGTGGAGCTGACCAACCT
GGTCTCCTACATGGGCATCTTGCACGAGAACCGCCTGGGGCAGAACGTGCTGCACACCACCCTGCGCGGGG
AGGCCCGGCGCGACTACATCCGCGACTGCGTCTACCTCTACCTCTGCCACACCTGGCAGACGGGCATGGGC
GTGTGGCAGCAGTGTCTGGAGGAGCAGAACCTGAAAGAGCTCTGCAAGCTCCTGCAGAAGAACCTCAAGG
GTCTGTGGACCGGGTTCGACGAGCGCACCACCGCCTCGGACCTGGCCGACCTCATTTTCCCCGAGCGCCTC
AGGCTGACGCTGCGCAACGGCCTGCCCGACTTTATGAGCCAAAGCATGTTGCAAAACTTTCGCTCTTTCATC
CTCGAACGCTCCGGAATCCTGCCCGCCACCTGCTCCGCGCTGCCCTCGGACTTCGTGCCGCTGACCTTCCGC
GAGTGCCCCCGCCGCTGTGGAGCCACTGCTACCTGCTGCGCCTGGCCAACTACCTGGCCTACCACTCGGA
CGTGATCGAGGACGTCAGCGGCGAGGGCCTGCTCGAGTGCCACTGCCGCTGCAACCTCTGCACGCCGCACC
GCTCCCTGGCCTGCAACCCCCAGCTGCTGAGCGAGACCCAGATCATCGGCACCTTCGAGTTGCAAGGGCCC
AGCGAAGGCGAGGGTTCAGCCGCCAAGGGGGGTCTGAAACTCACCCCGGGGCTGTGGACCTCGGCCTACT
```

-continued

```
TGCGCAAGTTCGTGCCCGAGGACTACCATCCCTTCGAGATCAGGTTCTACGAGGACCAATCCCATCCGCCC

AAGGCCGAGCTGTCGGCCTGCGTCATCACCCAGGGGCGATCCTGGCCCAATTGCAAGCCATCCAGAAATC

CCGCCAAGAATTCTTGCTGAAAAAGGGCCGCGGGGTCTACCTCGACCCCCAGACCGGTGAGGAGCTCAACC

CCGGCTTCCCCCAGGATGCCCCGAGGAAACAAGAAGCTGAAAGTGGAGCTGCCGCCCGTGGAGGATTTGG

AGGAAGACTGGGAGAACAGCAGTCAGGCAGAGGAGGAGGAGATGGAGGAAGACTGGGACAGCACTCAGG

CAGAGGAGGACAGCCTGCAAGACAGTCTGGAGGAAGACGAGGAGGAGGCAGAGGAGGAGGTGGAAGAAG

CAGCCGCCGCCAGACCGTCGTCCTCGGCGGGGAGAAAGCAAGCAGCACGGATACCATCTCCGCTCCGGG

TCGGGGTCCCGCTCGACCACACAGTAGATGGGACGAGACCGGACGATTCCCGAACCCCACCACCCAGACC

GGTAAGAAGGAGCGGCAGGGATACAAGTCCTGGCGGGGGCACAAAAACGCCATCGTCTCCTGCTTGCAGG

CCTGCGGGGCAACATCTCCTTCACCCGGCGCTACCTGCTCTTCCACCGCGGGGTGAACTTTCCCCGCAACA

TCTTGCATTACTACCGTCACCTCCACAGCCCCTACTACTTCCAAGAAGAGGCAGCAGCAGCAGAAAAAGAC

CAGCAGAAAACCAGCAGCTAGAAAATCCACAGCGGCGGCAGCAGGTGGACTGAGGATCGCGGCGAACGA

GCCGGCGCAAACCCGGGAGCTGAGGAACCGGATCTTTCCCACCCTCTATGCCATCTTCCAGCAGAGTCGGG

GGCAGGAGCAGGAACTGAAAGTCAAGAACCGTTCTCTGCGCTCGCTCACCCGCAGTTGTCTGTATCACAAG

AGCGAAGACCAACTTCAGCGCACTCTCGAGGACGCCGAGGCTCTCTTCAACAAGTACTGCGCGCTCACTCT

TAAAGAGTAGCCCGCGCCCGCCCAGTCGCAGAAAAAGGCGGGAATTACGTCACCTGTGCCCTTCGCCCTAG

CCGCCTCCACCCATCATCATGAGCAAAGAGATTCCCACGCCTTACATGTGGAGCTACCAGCCCCAGATGGG

CCTGGCCGCCGGTGCCGCCCAGGACTACTCCACCCGCATGAATTGGCTCAGCGCCGGGCCCGCGATGATCT

CACGGGTGAATGACATCCGCGCCCACCGAAACCAGATACTCCTAGAACAGTCAGCGCTCACCGCCACGCCC

CGCAATCACCTCAATCCGCGTAATTGGCCCGCCGCCCTGGTGTACCAGGAAATTCCCCAGCCCACGACCGT

ACTACTTCCGCGAGACGCCCAGGCCGAAGTCCAGCTGACTAACTCAGGTGTCCAGCTGGCGGGCGGCGCCA

CCCTGTGTCGTCACCGCCCCGCTCAGGGTATAAAGCGGCTGGTGATCCGGGGCAGAGGCACACAGCTCAAC

GACGAGGTGGTGAGCTCTTCGCTGGGTCTGCGACCTGACGGAGTCTTCCAACTCGCCGGATCGGGGAGATC

TTCCTTCACGCCTCGTCAGGCCGTCCTGACTTTGGAGAGTTCGTCCTCGCAGCCCCGCTCGGGTGGCATCGG

CACTCTCCAGTTCGTGGAGGAGTTCACTCCCTCGGTCTACTTCAACCCCTTCTCCGGCTCCCCGGCCACTA

CCCGGACGAGTTCATCCCGAACTTCGACGCCATCAGCGAGTCGGTGGACGGCTACGATTGAAACTAATCAC

CCCCTTATCCAGTGAAATAAAGATCATATTGATGATGATTTTACAGAAATAAAAAATAATCATTTGATTTGA

AATAAAGATACAATCATATTGATGATTTGAGTTTAACAAAAAAATAAAGAATCACTTACTTGAAATCTGAT

ACCAGGTCTCTGTCCATGTTTTCTGCCAACACCACTTCACTCCCCTCTTCCCAGCTCTGGTACTGCAGGCCCC

GGCGGGCTGCAAACTTCCTCCACACGCTGAAGGGGATGTCAAATTCCTCCTGTCCCTCAATCTTCATTTTAT

CTTCTATCAGATGTCCAAAAAGCGCGTCCGGGTGGATGATGACTTCGACCCCGTCTACCCCTACGATGCAG

ACAACGCACCGACCGTGCCCTTCATCAACCCCCCCTTCGTCTCTTCAGATGGATTCCAAGAGAAGCCCCTGG

GGGTGTTGTCCCTGCGACTGGCCGACCCCGTCACCACCAAGAACGGGGAAATCACCCTCAAGCTGGGAGA

GGGGGTGGACCTCGATTCCTCGGGAAAACTCATCTCCAACACGGCCACCAAGGCCGCCGCCCCTCTCAGTT

TTTCCAACAACACCATTTCCCTTAACATGGATCACCCCTTTTACACTAAAGATGGAAAATTATCCTTACAAG

TTTCTCCACCATTAAATATACTGAGAACAAGCATTCTAAACACACTAGCTTTAGGTTTTGGATCAGGTTTAG

GACTCCGTGGCTCTGCCTTGGCAGTACAGTTAGTCTCTCCACTTACATTTGATACTGATGGAAACATAAAGC

TTACCTTAGACAGAGGTTTGCATGTTACAACAGGAGATGCAATTGAAAGCAACATAAGCTGGGCTAAAGGT

TTAAAATTTGAAGATGGAGCCATAGCAACCAACATTGGAAATGGGTTAGAGTTTGGAAGCAGTAGTACAG

AAACAGGTGTTGATGATGCTTACCCAATCCAAGTTAAACTTGGATCTGGCCTTAGCTTTGACAGTACAGGA
```

-continued

```
GCCATAATGGCTGGTAACAAAGAAGACGATAAACTCACTTTGTGGACAACACCTGATCCATCACCAAACTG
TCAAATACTCGCAGAAAATGATGCAAAACTAACACTTTGCTTGACTAAATGTGGTAGTCAAATACTGGCCA
CTGTGTCAGTCTTAGTTGTAGGAAGTGGAAACCTAAACCCCATTACTGGCACCGTAAGCAGTGCTCAGGTG
TTTCTACGTTTTGATGCAAACGGTGTTCTTTTAACAGAACATTCTACACTAAAAAAATACTGGGGGTATAGG
CAGGGAGATAGCATAGATGGCACTCCATATACCAATGCTGTAGGATTCATGCCCAATTTAAAAGCTTATCC
AAAGTCACAAAGTTCTACTACTAAAAATAATATAGTAGGGCAAGTATACATGAATGGAGATGTTTCAAAAC
CTATGCTTCTCACTATAACCCTCAATGGTACTGATGACAGCAACAGTACATATTCAATGTCATTTTCATACA
CCTGGACTAATGGAAGCTATGTTGGAGCAACATTTGGGGCTAACTCTTATACCTTCTCATACATCGCCCAAG
AATGAACACTGTATCCCACCCTGCATGCCAACCCTTCCCACCCCACTCTGTGGAACAAACTCTGAAACACA
AAATAAAATAAAGTTCAAGTGTTTTATTGATTCAACAGTTTTACAGGATTCGAGCAGTTATTTTTCCTCCAC
CCTCCCAGGACATGGAATACACCACCCTCTCCCCCCGCACAGCCTTGAACATCTGAATGCCATTGGTGATG
GACATGCTTTTGGTCTCCACGTTCCACACAGTTTCAGAGCGAGCCAGTCTCGGGTCGGTCAGGGAGATGAA
ACCCTCCGGGCACTCCCGCATCTGCACCTCACAGCTCAACAGCTGAGGATTGTCCTCGGTGGTCGGGATCA
CGGTTATCTGGAAGAAGCAGAAGAGCGGCGGTGGGAATCATAGTCCGCGAACGGGATCGGCCGGTGGTGT
CGCATCAGGCCCCGCAGCAGTCGCTGCCGCCGCCGCTCCGTCAAGCTGCTGCTCAGGGGGTCCGGGTCCAG
GGACTCCCTCAGCATGATGCCCACGGCCCTCAGCATCAGTCGTCTGGTGCGGCGGGCGCAGCAGCGCATGC
GGATCTCGCTCAGGTCGCTGCAGTACGTGCAACACAGAACCACCAGGTTGTTCAACAGTCCATAGTTCAAC
ACGCTCCAGCCGAAACTCATCGCGGGAAGGATGCTACCCACGTGGCCGTCGTACCAGATCCTCAGGTAAAT
CAAGTGGTGCCCCCTCCAGAACACGCTGCCCACGTACATGATCTCCTTGGGCATGTGGCGGTTCACCACCTC
CCGGTACCACATCACCCTCTGGTTGAACATGCAGCCCCGGATGATCCTGCGGAACCACAGGGCCAGCACCG
CCCCGCCCGCCATGCAGCGAAGAGACCCCGGGTCCCGGCAATGGCAATGGAGGACCCACCGCTCGTACCC
GTGGATCATCTGGGAGCTGAACAAGTCTATGTTGGCACAGCACAGGCATATGCTCATGCATCTCTTCAGCA
CTCTCAACTCCTCGGGGGTCAAAACCATATCCCAGGGCACGGGGAACTCTTGCAGGACAGCGAACCCCGCA
GAACAGGGCAATCCTCGCACAGAACTTACATTGTGCATGGACAGGGTATCGCAATCAGGCAGCACCGGGT
GATCCTCCACCAGAGAAGCGCGGGTCTCGGTCTCCTCACAGCGTGGTAAGGGGGCCGGCCGATACGGGTG
ATGGCGGGACGCGGCTGATCGTGTTCGCGACCGTGTCATGATGCAGTTGCTTTCGGACATTTTCGTACTTGC
TGTAGCAGAACCTGGTCCGGGCGCTGCACACCGATCGCCGGCGGCGGTCTCGGCGCTTGGAACGCTCGGTG
TTGAAATTGTAAAACAGCCACTCTCTCAGACCGTGCAGCAGATCTAGGGCCTCAGGAGTGATGAAGATCCC
ATCATGCCTGATGGCTCTGATCACATCGACCACCGTGGAATGGGCCAGACCCAGCCAGATGATGCAATTTT
GTTGGGTTTCGGTGACGGCGGGGGAGGGAAGAACAGGAAGAACCATGATTAACTTTTAATCCAAACGGTCT
CGGAGTACTTCAAAATGAAGATCGCGGAGATGGCACCTCTCGCCCCCGCTGTGTTGGTGGAAAATAACAGC
CAGGTCAAAGGTGATACGGTTCTCGAGATGTTCCACGGTGGCTTCCAGCAAAGCCTCCACGCGCACATCCA
GAAACAAGACAATAGCGAAAGCGGGAGGGTTCTCTAATTCCTCAATCATCATGTTACACTCCTGCACCATC
CCCAGATAATTTTCATTTTTCCAGCCTTGAATGATTCGAACTAGTTCCTGAGGTAAATCCAAGCCAGCCATG
ATAAAGAGCTCGCGCAGAGCGCCCTCCACCGGCATTCTTAAGCACACCCTCATAATTCCAAGATATTCTGC
TCCTGGTTCACCTGCAGCAGATTGACAAGCGGAATATCAAAATCTCTGCCGCGATCCCTGAGCTCCTCCCTC
AGCAATAACTGTAAGTACTCTTTCATATCCTCTCCGAAATTTTTAGCCATAGGACCACCAGGAATAAGATTA
GGGCAAGCCACAGTACAGATAAACCGAAGTCCTCCCCAGTGAGCATTGCCAAATGCAAGACTGCTATAAG
CATGCTGGCTAGACCCGGTGATATCTTCCAGATAACTGGACAGAAAATCGCCCAGGCAATTTTTAAGAAAA
TCAACAAAAGAAAAATCCTCCAGGTGGACGTTTAGAGCCTCGGGAACAACGATGAAGTAAATGCAAGCGG
TGCGTTCCAGCATGGTTAGTTAGCTGATCTGTAGAAAAAACAAAAATGAACATTAAACCATGCTAGCCTGG
```

```
CGAACAGGTGGGTAAATCGTTCTCTCCAGCACCAGGCAGGCCACGGGGTCTCCGGCGCGACCCTCGTAAAA
ATTGTCGCTATGATTGAAAACCATCACAGAGAGACGTTCCCGGTGGCCGGCGTGAATGATTCGACAAGATG
AATACACCCCCGGAACATTGGCGTCCGCGAGTGAAAAAAAGCGCCCGAGGAAGCAATAAGGCACTACAAT
GCTCAGTCTCAAGTCCAGCAAAGCGATGCCATGCGGATGAAGCACAAAATTCTCAGGTGCGTACAAAATGT
AATTACTCCCCTCCTGCACAGGCAGCAAAGCCCCCGATCCCTCCAGGTACACATACAAAGCCTCAGCGTCC
ATAGCTTACCGAGCAGCAGCACACAACAGGCGCAAGAGTCAGAGAAAGGCTGAGCTCTAACCTGTCCACC
CGCTCTCTGCTCAATATATAGCCCAGATCTACACTGACGTAAAGGCCAAAGTCTAAAAATACCCGCCAAAT
AATCACACACGCCCAGCACACGCCCAGAAACCGGTGACACACTCAAAAAAATACGCGCACTTCCTCAAAC
GCCCAAAACTGCCGTCATTTCCGGGTTCCCACGCTACGTCATCAAAACACGACTTTCAAATTCCGTCGACCG
TTAAAAACGTCACCCGCCCCGCCCCTAACGGTCGCCCGTCTCTCAGCCAATCAGCGCCCCGCATCCCCAAA
TTCAAACACCTCATTTGCATATTAACGCGCACAAAAAGTTTGAGGTATATTATTGATGATGG

ChAdV68-CT-TSNA (SEQ ID NO: 66)
CATCATCAATAATATACCTCAAACTTTTTGTGCGCGTTAATATGCAAATGAGGCGTTTGAATTTGGGGAGGA
AGGGCGGTGATTGGTCGAGGGATGAGCGACCGTTAGGGGCGGGGCGAGTGACGTTTTGATGACGTGGTTG
CGAGGAGGAGCCAGTTTGCAAGTTCTCGTGGGAAAAGTGACGTCAAACGAGGTGTGGTTTGAACACGGAA
ATACTCAATTTTCCCGCGCTCTCTGACAGGAAATGAGGTGTTTCTGGGCGGATGCAAGTGAAAACGGGCCA
TTTTCGCGCGAAAACTGAATGAGGAAGTGAAAATCTGAGTAATTTCGCGTTTATGGCAGGGAGGAGTATTT
GCCGAGGGCCGAGTAGACTTTGACCGATTACGTGGGGGTTTCGATTACCGTGTTTTTCACCTAAATTTCCGC
GTACGGTGTCAAAGTCCGGTGTTTTTACGTAGGTGTCAGCTGATCGCCAGGGTATTTAAACCTGCGCTCTCC
AGTCAAGAGGCCACTCTTGAGTGCCAGCGAGAAGAGTTTTCTCCTCCGCGCCGCGAGTCAGATCTACACTT
TGAAAGTAGGGATAACAGGGTAATGACATTGATTATTGACTAGTTGTTAATAGTAATCAATTACGGGGTCA
TTAGTTCATAGCCCATATATGGAGTTCCGCGTTACATAACTTACGGTAAATGGCCCGCCTGGCTGACCGCCC
AACGACCCCCGCCCATTGACGTCAATAATGACGTATGTTCCCATAGTAACGCCAATAGGGACTTTCCATTG
ACGTCAATGGGTGGAGTATTTACGGTAAACTGCCCACTTGGCAGTACATCAAGTGTATCATATGCCAAGTC
CGCCCCCTATTGACGTCAATGACGGTAAATGGCCCGCCTGGCATTATGCCCAGTACATGACCTTACGGGAC
TTTCCTACTTGGCAGTACATCTACGTATTAGTCATCGCTATTACCATGGTGATGCGGTTTTGGCAGTACACC
AATGGGCGTGGATAGCGGTTTGACTCACGGGGATTTCCAAGTCTCCACCCCATTGACGTCAATGGGAGTTT
GTTTTGGCACCAAAATCAACGGGACTTTCCAAAATGTCGTAATAACCCCGCCCCGTTGACGCAAATGGGCG
GTAGGCGTGTACGGTGGGAGGTCTATATAAGCAGAGCTCGTTTAGTGAACCGTCAGATCGCCTGGAACGCC
ATCCACGCTGTTTTGACCTCCATAGAAGACAGCGATCGCGCCACCATGGCTGGCATGACCGAGTACAAGCT
GGTGGTAGTGGGAGCAGGGGATGTTGGAAAATCAGCCTTGACTATTCAGCTCATCCAGGGCACAGATCTGG
ATCACCAGGAGAAATGTCTCTCGCGACTGTACGACCACATGCCTGAGGGTCTGACCCCCCTTATGGGAGTG
TCGTCCTCTTCTGCGCTGGCCCGTCTCGGATTACCCATGGATAAACTCAATAAAATCACCGCCCCGGCGAGC
CAGAAGTTAAGACAACTGCAAAAGATGGAAACTCCTGAACTACTGCCCTGTGGGTATCTTGTAGAAGAAAA
TACCACGATCTCTGTGACAGTGAAGGGCCTGGAGGCTCAGAATAAGATCAAAGGGTGCACTGGGTCGGTG
AACATGACTTTACAGAGAGCCAGCGCAGCTCCTAAGACTGGTGGCGGGGGTGAAGCCGCTGCATACAACA
ACACTCTTGTGGCACGGCACGTGCCCCAGATACCAAAGCCCGATTCCTTGGTGGGGCTTAGTGATGAGTTG
GGGAAGCGGGACACTTTTGCAGAGTCTCTGATTCGTAGGATGGCATCCGCGGGCTACCTGTTCCTGGACAT
CATCACATACGTGGTCTTTGCTGTAACCTTCGTGCTTGGTGTTTTAGGAGGGCTGAACACAGAAACCAATGA
GAAGGCTTTAGAAGCTGTGTTTGGCAAGTATGGAAGAATAGTGGAGGTGCTGGGGGGCCGGTCATGCGAG
GAGCTGACGGCGGTACTTCCTCCACCTCAGCTTTTGGGCAGGAGATTTAACTTCTTCTCATACTCCTATGTG
```

```
GCCGCAGGAAGTTCCGGGAATAACTATGACCTCATGGCCCAACCCATCACGCCCGGGCCCGACACAACCCC

GTTACCAGTGACCGATACTAGTTCCGTGAGTACAGGCCACGCCACCAGCCTGCCTGTGACTGACGCTGGAC

TCAGGGTTACAGAGAGTAAGGGGCACAGCGATTCATGGCACCTGTCTTTGGATACGGCCATCAGGGTCAAC

ACCCCTAAACTGGTGTCCGAGGTTGAGGAACTCAACAAAAGCATTACAGCGCTACGAGAAAAGCTACTGC

AGATGGTGGAGGCCGACAGACCCGGAAACCTCTTCATTGGGGGCTTAAATACAGAGACTAATGAAGACAG

CCCGGTCAAGGATGAAGTAGTGGTGAATGATCAGTGGGGACAGAACTGCAGCTGCCACCACGGCGGTTAC

GAGTTTCCGGACCTGCACCGCACCATCGTGTCTGAGTGTGACGTGTACCTCACCTACATGCTGCGCCAGGCC

GCCCTTCAGCTGTTCTTTGATCTCTACCACTCCATTCCGTCAAGCTTCAGCCCCTTAGTCCTCAGCTGTTTAG

TGCAGCCCTTGGAAGATGTGGAGGTCATGGAGAAGGACGGCACCACATTCTCCTGTGAAGTTTCTCATGAC

GAGGTTCCTCGGACATATGGACCCGTGTTTATGTGTCTGGGAGGACTGCTGACCATGGTGGCTGGAGCTGTT

TGGCTGACAGTTGGACCCGGACCAGGCGCCAAATTTGTTGCTGCTTGGACACTGAAAGCTGCTGCTGGGCC

CGGACCAGGCCAGTACATCAAGGCCAACTCTAAGTTTATCGGCATCACCGAATTGGGACCTGGACCCGGCT

AGTAGTGAGTTTAAACTCCCATTTAAATGTGAGGGTTAATGCTTCGAGCAGACATGATAAGATACATTGAT

GAGTTTGGACAAACCACAACTAGAATGCAGTGAAAAAAATGCTTTATTTGTGAAATTTGTGATGCTATTGC

TTTATTTGTAACCATTATAAGCTGCAATAAACAAGTTAACAACAACAATTGCATTCATTTTATGTTTCAGGT

TCAGGGGGAGATGTGGGAGGTTTTTTAAAGCAAGTAAAACCTCTACAAATGTGGTAAAATAACTATAACGG

TCCTAAGGTAGCGAGTGAGTAGTGTTCTGGGGCGGGGGAGGACCTGCATGAGGGCCAGAATAACTGAAAT

CTGTGCTTTTCTGTGTGTTGCAGCAGCATGAGCGGAAGCGGCTCCTTTGAGGGAGGGGTATTCAGCCCTTAT

CTGACGGGCGTCTCCCCTCCTGGGCGGGAGTGCGTCAGAATGTGATGGGATCCACGGTGGACGGCCGGCC

CGTGCAGCCCGCGAACTCTTCAACCCTGACCTATGCAACCCTGAGCTCTTCGTCGTTGGACGCAGCTGCCGC

CGCAGCTGCTGCATCTGCCGCCAGCGCCGTGCGCGGAATGGCCATGGGCGCCGGCTACTACGGCACTCTGG

TGGCCAACTCGAGTTCCACCAATAATCCCGCCAGCCTGAACGAGGAGAAGCTGTTGCTGCTGATGGCCCAG

CTCGAGGCCTTGACCCAGCGCCTGGGCGAGCTGACCCAGCAGGTGGCTCAGCTGCAGGAGCAGACGCGGG

CCGCGGTTGCCACGGTGAAATCCAAATAAAAAATGAATCAATAAATAAACGGAGACGGTTGTTGATTTTAA

CACAGAGTCTGAATCTTTATTTGATTTTTCGCGCGCGGTAGGCCCTGGACCACCGGTCTCGATCATTGAGCA

CCCGGTGGATCTTTTCCAGGACCCGGTAGAGGTGGGCTTGGATGTTGAGGTACATGGGCATGAGCCCGTCC

CGGGGGTGGAGGTAGCTCCATTGCAGGGCCTCGTGCTCGGGGTGGTGTTGTAAATCACCCAGTCATAGCA

GGGGCGCAGGGCATGGTGTTGCACAATATCTTTGAGGAGGAGACTGATGGCCACGGGCAGCCCTTTGGTGT

AGGTGTTTACAAATCTGTTGAGCTGGGAGGGATGCATGCGGGGGAGATGAGGTGCATCTTGGCCTGGATC

TTGAGATTGGCGATGTTACCGCCCAGATCCCGCCTGGGGTTCATGTTGTGCAGGACCACCAGCACGGTGTA

TCCGGTGCACTTGGGGAATTTATCATGCAACTTGGAAGGGAAGGCGTGAAAGAATTTGGCGACGCCTTTGT

GCCCGCCCAGGTTTTCCATGCACTCATCCATGATGATGGCGATGGGCCCGTGGGCGGCGGCCTGGGCAAAG

ACGTTTCGGGGTCGGACACATCATAGTTGTGGTCCTGGGTGAGGTCATCATAGGCCATTTTAATGAATTTG

GGGCGGAGGGTGCCGGACTGGGGGACAAAGGTACCCTCGATCCCGGGGCGTAGTTCCCCTCACAGATCT

GCATCTCCCAGGCTTTGAGCTCGGAGGGGGGATCATGTCCACCTGCGGGGCGATAAAGAACACGGTTTCC

GGGGCGGGGGAGATGAGCTGGGCCGAAAGCAAGTTCCGGAGCAGCTGGGACTTGCCGCAGCCGGTGGGGC

CGTAGATGACCCCGATGACCGGCTGCAGGTGGTAGTTGAGGGAGAGACAGCTGCCGTCCTCCCGGAGGAG

GGGGGCCACCTCGTTCATCATCTCGCGCACGTGCATGTTCTCGCGCACCAGTTCCGCCAGGAGGCGCTCTCC

CCCCAGGGATAGGAGCTCCTGGAGCGAGGCGAAGTTTTTCAGCGGCTTGAGTCCGTCGGCCATGGGCATTT

TGGAGAGGGTTTGTTGCAAGAGTTCCAGGCGGTCCCAGAGCTCGGTGATGTGCTCTACGGCATCTCGATCC
```

-continued

```
AGCAGACCTCCTCGTTTCGCGGGTTGGGACGGCTGCGGGAGTAGGGCACCAGACGATGGGCGTCCAGCGC

AGCCAGGGTCCGGTCCTTCCAGGGTCGCAGCGTCCGCGTCAGGGTGGTCTCCGTCACGGTGAAGGGGTGCG

CGCCGGGCTGGGCGCTTGCGAGGGTGCGCTTCAGGCTCATCCGGCTGGTCGAAAACCGCTCCCGATCGGCG

CCCTGCGCGTCGGCCAGGTAGCAATTGACCATGAGTTCGTAGTTGAGCGCCTCGGCCGCGTGGCCTTTGGC

GCGGAGCTTACCTTTGGAAGTCTGCCCGCAGGCGGGACAGAGGAGGGACTTGAGGGCGTAGAGCTTGGGG

GCGAGGAAGACGGACTCGGGGGCGTAGGCGTCCGCGCCGCAGTGGGCGCAGACGGTCTCGCACTCCACGA

GCCAGGTGAGGTCGGGCTGGTCGGGGTCAAAAACCAGTTTCCCGCCGTTCTTTTTGATGCGTTTCTTACCTT

TGGTCTCCATGAGCTCGTGTCCCCGCTGGGTGACAAAGAGGCTGTCCGTGTCCCCGTAGACCGACTTTATGG

GCCGGTCCTCGAGCGGTGTGCCGCGGTCCTCCTCGTAGAGGAACCCCGCCCACTCCGAGACGAAAGCCCGG

GTCCAGGCCAGCACGAAGGAGGCCACGTGGGACGGGTAGCGGTCGTTGTCCACCAGCGGGTCCACCTTTTC

CAGGGTATGCAAACACATGTCCCCCTCGTCCACATCCAGGAAGGTGATTGGCTTGTAAGTGTAGGCCACGT

GACCGGGGGTCCCGGCCGGGGGGGTATAAAAGGGTGCGGGTCCCTGCTCGTCCTCACTGTCTTCCGGATCG

CTGTCCAGGAGCGCCAGCTGTTGGGGTAGGTATTCCCTCTCGAAGGCGGGCATGACCTCGGCACTCAGGTT

GTCAGTTTCTAGAAACGAGGAGGATTTGATATTGACGGTGCCGGCGGAGATGCCTTTCAAGAGCCCCTCGT

CCATCTGGTCAGAAAAGACGATCTTTTTGTTGTCGAGCTTGGTGGCGAAGGAGCCGTAGAGGGCGTTGGAG

AGGAGCTTGGCGATGGAGCGCATGGTCTGGTTTTTTTCCTTGTCGGCGCGCTCCTTGGCGGCGATGTTGAGC

TGCACGTACTCGCGCGCCACGCACTTCCATTCGGGGAAGACGGTGGTCAGCTCGTCGGGCACGATTCTGAC

CTGCCAGCCCCGATTATGCAGGGTGATGAGGTCCACACTGGTGGCCACCTCGCCGCGCAGGGGCTCATTAG

TCCAGCAGAGGCGTCCGCCCTTGCGCGAGCAGAAGGGGGCAGGGGGTCCAGCATGACCTCGTCGGGGGG

GTCGGCATCGATGGTGAAGATGCCGGGCAGGAGGTCGGGGTCAAAGTAGCTGATGGAAGTGGCCAGATCG

TCCAGGGCAGCTTGCCATTCGCGCACGGCCAGCGCGCGCTCGTAGGGACTGAGGGGCGTGCCCCAGGGCAT

GGGATGGGTAAGCGCGGAGGCGTACATGCCGCAGATGTCGTAGACGTAGAGGGGCTCCTCGAGGATGCCG

ATGTAGGTGGGGTAGCAGCGCCCCCCGCGGATGCTGGCGCGCACGTAGTCATACAGCTCGTGCGAGGGGG

CGAGGAGCCCCGGGCCCAGGTTGGTGCGACTGGGCTTTTCGGCGCGGTAGACGATCTGGCGGAAAATGGC

ATGCGAGTTGGAGGAGATGGTGGGCCTTTGGAAGATGTTGAAGTGGGCGTGGGGCAGTCCGACCGAGTCG

CGGATGAAGTGGCGTAGGAGTCTTGCAGCTTGGCGACGAGCTCGGCGGTGACTAGGACGTCCAGAGCGC

AGTAGTCGAGGGTCTCCTGGATGATGTCATACTTGAGCTGTCCCTTTTGTTTCCACAGCTCGCGGTTGAGAA

GGAACTCTTCGCGGTCCTTCCAGTACTCTTCGAGGGGGAACCCGTCCTGATCTGCACGGTAAGAGCCTAGC

ATGTAGAACTGGTTGACGGCCTTGTAGGCGCAGCAGCCCTTCTCCACGGGGAGGGCGTAGGCCTGGGCGGC

CTTGCGCAGGGAGGTGTGCGTGAGGGCGAAAGTGTCCCTGACCATGACCTTGAGGAACTGGTGCTTGAAGT

CGATATCGTCGCAGCCCCCCTGCTCCCAGAGCTGGAAGTCCGTGCGCTTCTTGTAGGCGGGGTTGGGCAAA

GCGAAAGTAACATCGTTGAAGAGGATCTTGCCCGCGCGGGGCATAAAGTTGCGAGTGATGCGGAAAGGTT

GGGGCACCTCGGCCCGGTTGTTGATGACCTGGGCGGCGAGCACGATCTCGTCGAAGCCGTTGATGTTGTGG

CCCACGATGTAGAGTTCCACGAATCGCGGACGGCCCTTGACGTGGGCAGTTTCTTGAGCTCCTCGTAGGT

GAGCTCGTCGGGGTCGCTGAGCCCGTGCTGCTCGAGCGCCCAGTCGGCGAGATGGGGGTTGGCGCGGACG

AAGGAAGTCCAGAGATCCACGCCAGGGCGGTTTGCAGACGGTCCCGGTACTGACGGAACTGCTGCCCGA

CGGCCATTTTTTCGGGGGTGACGCAGTAGAAGGTGCGGGGGTCCCCGTGCCAGCGATCCCATTTGAGCTGG

AGGGCGAGATCGAGGGCGAGCTCGACGAGCCGGTCGTCCCCGGAGAGTTTCATGACCAGCATGAAGGGGA

CGAGCTGCTTGCCGAAGGACCCCATCCAGGTGTAGGTTTCCACATCGTAGGTGAGGAAGAGCCTTTCGGTG

CGAGGATGCGAGCCGATGGGGAAGAACTGGATCTCCTGCCACCAATTGGAGGAATGGCTGTTGATGTGATG

GAAGTAGAAATGCCGACGGCGCGCCCGAACACTCGTGCTTGTGTTTATACAAGCGGCCACAGTGCTCGCAAC
```

-continued

```
GCTGCACGGGATGCACGTGCTGCACGAGCTGTACCTGAGTTCCTTTGACGAGGAATTTCAGTGGGAAGTGG

AGTCGTGGCGCCTGCATCTCGTGCTGTACTACGTCGTGGTGGTCGGCCTGGCCCTCTTCTGCCTCGATGGTG

GTCATGCTGACGAGCCCGCGCGGGAGGCAGGTCCAGACCTCGGCGCGAGCGGGTCGGAGAGCGAGGACGA

GGGCGCGCAGGCCGGAGCTGTCCAGGGTCCTGAGACGCTGCGGAGTCAGGTCAGTGGGCAGCGGCGGCGC

GCGGTTGACTTGCAGGAGTTTTTCCAGGGCGCGCGGGAGGTCCAGATGGTACTTGATCTCCACCGCGCCAT

TGGTGGCGACGTCGATGGCTTGCAGGGTCCCGTGCCCCTGGGGTGTGACCACCGTCCCCCGTTTCTTCTTGG

GCGGCTGGGGCGACGGGGGCGGTGCCTCTTCCATGGTTAGAAGCGGCGGCGAGGACGCGCGCCGGGCGGC

AGGGGCGGCTCGGGGCCCGGAGGCAGGGGCGGCAGGGGCACGTCGGCGCCGCGCGCGGGTAGGTTCTGGT

ACTGCGCCCGGAGAAGACTGGCGTGAGCGACGACGCGACGGTTGACGTCCTGGATCTGACGCCTCTGGGTG

AAGGCCACGGGACCCGTGAGTTTGAACCTGAAAGAGAGTTCGACAGAATCAATCTCGGTATCGTTGACGGC

GGCCTGCCGCAGGATCTCTTGCACGTCGCCCGAGTTGTCCTGGTAGGCGATCTCGGTCATGAACTGCTCGAT

CTCCTCCTCTTGAAGGTCTCCGCGGCCGGCGCGCTCCACGGTGGCCGCGAGGTCGTTGGAGATGCGGCCCA

TGAGCTGCGAGAAGGCGTTCATGCCCGCCTCGTTCCAGACGCGGCTGTAGACCACGACGCCCTCGGGATCG

CGGGCGCGCATGACCACCTGGGCGAGGTTGAGCTCCACGTGGCGCGTGAAGACCGCGTAGTTGCAGAGGC

GCTGGTAGAGGTAGTTGAGCGTGGTGGCGATGTGCTCGGTGACGAAGAAATACATGATCCAGCGGCGGAG

CGGCATCTCGCTGACGTCGCCCAGCGCCTCCAAACGTTCCATGGCCTCGTAAAAGTCCACGGCGAAGTTGA

AAAACTGGGAGTTGCGCGCCGAGACGGTCAACTCCTCCTCCAGAAGACGGATGAGCTCGGCGATGGTGGC

GCGCACCTCGCGCTCGAAGGCCCCCGGGAGTTCCTCCACTTCCTCTTCTTCCTCCTCCACTAACATCTCTTCT

ACTTCCTCCTCAGGCGGCAGTGGTGGCGGGGGAGGGGGCCTGCGTCGCCGGCGGCGCACGGGCAGACGGT

CGATGAAGCGCTCGATGGTCTCGCCGCGCCGGCGTCGCATGGTCTCGGTGACGGCGCGCCCGTCCTCGCGG

GGCCGCAGCGTGAAGACGCCGCCGCGCATCTCCAGGTGGCCGGGGGGGTCCCCGTTGGGCAGGGAGAGGG

CGCTGACGATGCATCTTATCAATTGCCCCGTAGGGACTCCGCGCAAGGACCTGAGCGTCTCGAGATCCACG

GGATCTGAAAACCGCTGAACGAAGGCTTCGAGCCAGTCGCAGTCGCAAGGTAGGCTGAGCACGGTTTCTTC

TGGCGGGTCATGTTGGTTGGGAGCGGGCGGGCGATGCTGCTGGTGATGAAGTTGAAATAGGCGGTTCTGA

GACGGCGGATGGTGGCGAGGAGCACCAGGTCTTTGGGCCCGGCTTGCTGGATGCGCAGACGGTCGGCCAT

GCCCCAGGCGTGGTCCTGACACCTGGCCAGGTCCTTGTAGTAGTCCTGCATGAGCCGCTCCACGGGCACCT

CCTCCTCGCCCGCGCGCCGTGCATGCGCGTGAGCCCGAAGCCGCGCTGGGGCTGGACGAGCGCCAGGTCG

GCGACGACGCGCTCGGCGAGGATGGCTTGCTGGATCTGGGTGAGGGTGGTCTGGAAGTCATCAAAGTCGAC

GAAGCGGTGGTAGGCTCCGGTGTTGATGGTGTAGGAGCAGTTGGCCATGACGGACCAGTTGACGGTCTGGT

GGCCCGGACGCACGAGCTCGTGGTACTTGAGGCGCGAGTAGGCGCGCGTGTCGAAGATGTAGTCGTTGCAG

GTGCGCACCAGGTACTGGTAGCCGATGAGGAAGTGCGGCGGCGGCTGGCGGTAGAGCGGCCATCGCTCGG

TGGCGGGGGCGCCGGGCGCGAGGTCCTCGAGCATGGTGCGGTGGTAGCCGTAGATGTACCTGGACATCCA

GGTGATGCCGGCGGCGGTGGTGGAGGCGCGCGGGAACTCGCGGACGCGGTTCCAGATGTTGCGCAGCGGC

AGGAAGTAGTTCATGGTGGGCACGGTCTGGCCCGTGAGGCGCGCGCAGTCGTGGATGCTCTATACGGGCAA

AAACGAAAGCGGTCAGCGGCTCGACTCCTGGCCTGGAGGCTAAGCGAACGGGTTGGGCTGCGCGTGTAC

CCCGGTTCGAATCTCGAATCAGGCTGGAGCCGCAGCTAACGTGGTATTGGCACTCCCGTCTCGACCCAAGC

CTGCACCAACCCTCCAGGATACGGAGGCGGGTCGTTTTGCAACTTTTTTTTGGAGGCCGGATGAGACTAGT

AAGCGCGGAAAGCGGCCGACCGCGATGGCTCGCTGCCGTAGTCTGGAGAAGAATCGCCAGGGTTGCGTTG

CGGTGTGCCCCGGTTCGAGGCCGGCCGGATTCCGCGGCTAACGAGGGCGTGGCTGCCCCGTCGTTTCCAAG

ACCCCATAGCCAGCCGACTTCTCCAGTTACGGAGCGAGCCCCTCTTTTGTTTTGTTTGTTTTGCCAGATGCA
```

-continued

```
TCCCGTACTGCGGCAGATGCGCCCCCACCACCCTCCACCGCAACAACAGCCCCCTCCACAGCCGGCGCTTC
TGCCCCCGCCCCAGCAGCAACTTCCAGCCACGACCGCCGCGCCGCCGTGAGCGGGGCTGGACAGAGTTAT
GATCACCAGCTGGCCTTGGAAGAGGGCGAGGGGCTGGCGCGCCTGGGGGCGTCGTCGCCGGAGCGGCACC
CGCGCGTGCAGATGAAAAGGGACGCTCGCGAGGCCTACGTGCCCAAGCAGAACCTGTTCAGAGACAGGAG
CGGCGAGGAGCCCGAGGAGATGCGCGCGGCCCGGTTCCACGCGGGGCGGGAGCTGCGGCGCGGCCTGGAC
CGAAAGAGGGTGCTGAGGGACGAGGATTTCGAGGCGGACGAGCTGACGGGGATCAGCCCCGCGCGCGCGC
ACGTGGCCGCGGCCAACCTGGTCACGGCGTACGAGCAGACCGTGAAGGAGGAGAGCAACTTCCAAAAATC
CTTCAACAACCACGTGCGCACCCTGATCGCGCGCGAGGAGGTGACCCTGGGCCTGATGCACCTGTGGGACC
TGCTGGAGGCCATCGTGCAGAACCCCACCAGCAAGCCGCTGACGGCGCAGCTGTTCCTGGTGGTGCAGCAT
AGTCGGGACAACGAAGCGTTCAGGGAGGCGCTGCTGAATATCACCGAGCCCGAGGGCCGCTGGCTCCTGG
ACCTGGTGAACATTCTGCAGAGCATCGTGGTGCAGGAGCGCGGGCTGCCGCTGTCCGAGAAGCTGGCGGCC
ATCAACTTCTCGGTGCTGAGTTTGGGCAAGTACTACGCTAGGAAGATCTACAAGACCCCGTACGTGCCCAT
AGACAAGGAGGTGAAGATCGACGGGTTTTACATGCGCATGACCCTGAAAGTGCTGACCCTGAGCGACGAT
CTGGGGGTGTACCGCAACGACAGGATGCACCGTGCGGTGAGCGCCAGCAGGCGGCGCGAGCTGAGCGACC
AGGAGCTGATGCATAGTCTGCAGCGGGCCCTGACCGGGGCCGGGACCGAGGGGGAGAGCTACTTTGACAT
GGGCGCGGACCTGCACTGGCAGCCCAGCCGCCGGGCCTTGGAGGCGGCGGCAGGACCCTACGTAGAAGAG
GTGGACGATGAGGTGGACGAGGAGGGCGAGTACCTGGAAGACTGATGGCGCGACCGTATTTTTGCTAGAT
GCAACAACAACAGCCACCTCCTGATCCCGCGATGCGGGCGGCGCTGCAGAGCCAGCCGTCCGGCATTAACT
CCTCGGACGATTGGACCCAGGCCATGCAACGCATCATGGCGCTGACGACCCGCAACCCCGAAGCCTTTAGA
CAGCAGCCCCAGGCCAACCGGCTCTCGGCCATCCTGGAGGCCGTGGTGCCCTCGCGCTCCAACCCCACGCA
CGAGAAGGTCCTGGCCATCGTGAACGCGCTGGTGGAGAACAAGGCCATCCGCGGCGACGAGGCCGGCCTG
GTGTACAACGCGCTGCTGGAGCGCGTGGCCCGCTACAACAGCACCAACGTGCAGACCAACCTGGACCGCA
TGGTGACCGACGTGCGCGAGGCCGTGGCCCAGCGCGAGCGGTTCCACCGCGAGTCCAACCTGGGATCCATG
GTGGCGCTGAACGCCTTCCTCAGCACCCAGCCCGCCAACGTGCCCCGGGGCCAGGAGGACTACACCAACTT
CATCAGCGCCCTGCGCCTGATGGTGACCGAGGTGCCCCAGAGCGAGGTGTACCAGTCCGGGCCGGACTACT
TCTTCCAGACCAGTCGCCAGGGCTTGCAGACCGTGAACCTGAGCCAGGCTTTCAAGAACTTGCAGGGCCTG
TGGGGCGTGCAGGCCCCGGTCGGGGACCGCGCGACGGTGTCGAGCCTGCTGACGCCGAACTCGCGCCTGCT
GCTGCTGCTGGTGGCCCCCTTCACGGACAGCGGCAGCATCAACCGCAACTCGTACCTGGGCTACCTGATTA
ACCTGTACCGCGAGGCCATCGGCCAGGCGCACGTGGACGAGCAGACCTACCAGGAGATCACCCACGTGAG
CCGCGCCCTGGGCCAGGACGACCCGGGCAACCTGGAAGCCACCCTGAACTTTTTGCTGACCAACCGGTCGC
AGAAGATCCCGCCCCAGTACGCGCTCAGCACCGAGGAGGAGCGCATCCTGCGTTACGTGCAGCAGAGCGT
GGGCCTGTTCCTGATGCAGGAGGGGCCACCCCCAGCGCCGCGCTCGACATGACCGCGCGCAACATGGAG
CCCAGCATGTACGCCAGCAACCGCCCGTTCATCAATAAACTGATGGACTACTTGCATCGGGCGGCCGCCAT
GAACTCTGACTATTTCACCAACGCCATCCTGAATCCCCACTGGCTCCCGCCGCCGGGGTTCTACACGGGCG
AGTACGACATGCCCGACCCCAATGACGGGTTCCTGTGGGACGATGTGGACAGCAGCGTGTTCTCCCCCCGA
CCGGGTGCTAACGAGCGCCCCTTGTGGAAGAAGGAAGGCAGCGACCGACGCCCGTCCTCGGCGCTGTCCG
GCCGCGAGGGTGCTGCCGCGGCGGTGCCCGAGGCCGCCAGTCCTTTCCCGAGCTTGCCCTTCTCGCTGAAC
AGTATCCGCAGCAGCGAGCTGGGCAGGATCACGCGCCCGCGCTTGCTGGGCGAAGAGGAGTACTTGAATG
ACTCGCTGTTGAGACCCGAGCGGGAGAAGAACTTCCCCAATAACGGGATAGAAAGCCTGGTGGACAAGAT
GAGCCGCTGGAAGACGTATGCGCAGGAGCACAGGGACGATCCCCGGGCGTCGCAGGGGGCCACGAGCCGG
GGCAGCGCCGCCCGTAAACGCCGGTGGCACGACAGGCAGCGGGACAGATGTGGGACGATGAGGACTCCG
```

-continued

```
CCGACGACAGCAGCGTGTTGGACTTGGGTGGGAGTGGTAACCCGTTCGCTCACCTGCGCCCCGTATCGGG
CGCATGATGTAAGAGAAACCGAAAATAAATGATACTCACCAAGGCCATGGCGACCAGCGTGCGTTCGTTTC
TTCTCTGTTGTTGTTGTATCTAGTATGATGAGGCGTGCGTACCCGGAGGGTCCTCCTCCCTCGTACGAGAGC
GTGATGCAGCAGGCGATGGCGGCGGCGGCGATGCAGCCCCCGCTGGAGGCTCCTTACGTGCCCCGCGGTA
CCTGGCGCCTACGGAGGGGCGGAACAGCATTCGTTACTCGGAGCTGGCACCCTTGTACGATACCACCCGGT
TGTACCTGGTGGACAACAAGTCGGCGGACATCGCCTCGCTGAACTACCAGAACGACCACAGCAACTTCCTG
ACCACCGTGGTGCAGAACAATGACTTCACCCCCACGGAGGCCAGCACCCAGACCATCAACTTTGACGAGCG
CTCGCGGTGGGGCGGCCAGCTGAAAACCATCATGCACACCAACATGCCCAACGTGAACGAGTTCATGTACA
GCAACAAGTTCAAGGCGCGGGTGATGGTCTCCCGCAAGACCCCCAATGGGGTGACAGTGACAGAGGATTA
TGATGGTAGTCAGGATGAGCTGAAGTATGAATGGGTGGAATTTGAGCTGCCCGAAGGCAACTTCTCGGTGA
CCATGACCATCGACCTGATGAACAACGCCATCATCGACAATTACTTGGCGGTGGGGCGGCAGAACGGGGT
GCTGGAGAGCGACATCGGCGTGAAGTTCGACACTAGGAACTTCAGGCTGGGCTGGGACCCCGTGACCGAG
CTGGTCATGCCCGGGGTGTACACCAACGAGGCTTTCCATCCCGATATTGTCTTGCTGCCCGGCTGCGGGTG
GACTTCACCGAGAGCCGCCTCAGCAACCTGCTGGGCATTCGCAAGAGGCAGCCCTTCCAGGAAGGCTTCCA
GATCATGTACGAGGATCTGGAGGGGGGCAACATCCCCGCGCTCCTGGATGTCGACGCCTATGAGAAAGC
AAGGAGGATGCAGCAGCTGAAGCAACTGCAGCCGTAGCTACCGCCTCTACCGAGGTCAGGGGCGATAATT
TTGCAAGCGCCGCAGCAGTGGCAGCGGCCGAGGCGGCTGAAACCGAAAGTAAGATAGTCATTCAGCCGGT
GGAGAAGGATAGCAAGAACAGGAGCTACAACGTACTACCGGACAAGATAAACACCGCCTACCGCAGCTGG
TACCTAGCCTACAACTATGGCGACCCCGAGAAGGGCGTGCGCTCCTGGACGCTGCTCACCACCTCGGACGT
CACCTGCGGCGTGGAGCAAGTCTACTGGTCGCTGCCCGACATGATGCAAGACCCGGTCACCTTCCGCTCCA
CGCGTCAAGTTAGCAACTACCCGGTGGTGGGCGCCGAGCTCCTGCCCGTCTACTCCAAGAGCTTCTTCAAC
GAGCAGGCCGTCTACTCGCAGCAGCTGCGCGCCTTCACCTCGCTTACGCACGTCTTCAACCGCTTCCCCGAG
AACCAGATCCTCGTCCGCCCGCCCGCGCCCACCATTACCACCGTCAGTGAAAACGTTCCTGCTCTCACAGAT
CACGGGACCCTGCCGCTGCGCAGCAGTATCCGGGGAGTCCAGCGCGTGACCGTTACTGACGCCAGACGCCG
CACCTGCCCCTACGTCTACAAGGCCCTGGGCATAGTCGCGCCGCGCGTCCTCTCGAGCCGCACCTTCTAAAT
GTCCATTCTCATCTCGCCCAGTAATAACACCGGTTGGGGCCTGCGCGCGCCCAGCAAGATGTACGGAGGCG
CTCGCCAACGCTCCACGCAACACCCCGTGCGCGTGCGCGGGCACTTCCGCGCTCCCTGGGGCGCCCTCAAG
GGCCGCGTGCGGTCGCGCACCACCGTCGACGACGTGATCGACCAGGTGGTGGCCGACGCGCGCAACTACA
CCCCCGCCGCCGCGCCCGTCTCCACCGTGGACGCCGTCATCGACAGCGTGGTGGCCGACGCGCGCCGGTAC
GCCCGCGCCAAGAGCCGGCGGCGGCGCATCGCCCGGCGGCACCGGAGCACCCCCGCCATGCGCGCGGCGC
GAGCCTTGCTGCGCAGGGCCAGGCGCACGGGACGCAGGGCCATGCTCAGGGCGGCCAGACGCGCGGCTTC
AGGCGCCAGCGCCGGCAGGACCCGGAGACGCGCGGCCACGGCGGCGGCAGCGGCCATCGCCAGCATGTCC
CGCCCGCGGCGAGGGAACGTGTACTGGGTGCGCGACGCCGCCACCGGTGTGCGCGTGCCCGTGCGCACCC
GCCCCCCTCGCACTTGAAGATGTTCACTTCGCGATGTTGATGTGTCCCAGCGGCGAGGAGGATGTCCAAGC
GCAAATTCAAGGAAGAGATGCTCCAGGTCATCGCGCCTGAGATCTACGGCCCTGCGGTGGTGAAGGAGGA
AAGAAAGCCCCGCAAAATCAAGCGGGTCAAAAAGGACAAAAAGGAAGAAGAAAGTGATGTGGACGGATT
GGTGGAGTTTGTGCGCGAGTTCGCCCCCCGGCGGCGCGTGCAGTGGCGCGGGCGGAAGGTGCAACCGGTG
CTGAGACCCGGCACCACCGTGGTCTTCACGCCCGGCGAGCGCTCCGGCACCGCTTCCAAGCGCTCCTACGA
CGAGGTGTACGGGGATGATGATATTCTGGAGCAGGCGGCCGAGCGCCTGGGCGAGTTTGCTTACGGCAAGC
GCAGCCGTTCCGCACCGAAGGAAGAGGCGGTGTCCATCCCGCTGGACCACGGCAACCCCACGCCGAGCCT
```

-continued

```
CAAGCCCGTGACCTTGCAGCAGGTGCTGCCGACCGCGGCGCCGCGCCGGGGGTTCAAGCGCGAGGGCGAG

GATCTGTACCCCACCATGCAGCTGATGGTGCCCAAGCGCCAGAAGCTGGAAGACGTGCTGGAGACCATGA

AGGTGGACCCGGACGTGCAGCCCGAGGTCAAGGTGCGGCCCATCAAGCAGGTGGCCCCGGGCCTGGGCGT

GCAGACCGTGGACATCAAGATTCCCACGGAGCCCATGGAAACGCAGACCGAGCCCATGATCAAGCCCAGC

ACCAGCACCATGGAGGTGCAGACGGATCCCTGGATGCCATCGGCTCCTAGTCGAAGACCCCGGCGCAAGT

ACGGCGCGGCCAGCCTGCTGATGCCCAACTACGCGCTGCATCCTTCCATCATCCCCACGCCGGGCTACCGC

GGCACGCGCTTCTACCGCGGTCATACCAGCAGCCGCCGCCGCAAGACCACCACTCGCCGCCGCCGTCGCCG

CACCGCCGCTGCAACCACCCCTGCCGCCCTGGTGCGGAGAGTGTACCGCCGCGGCCGCGCACCTCTGACCC

TGCCGCGCGCGCTACCACCCGAGCATCGCCATTTAAACTTTCGCCTGCTTTGCAGATCAATGGCCCTCAC

ATGCCGCCTTCGCGTTCCCATTACGGGCTACCGAGGAAGAAAACCGCGCCGTAGAAGGCTGGCGGGGAAC

GGGATGCGTCGCCACCACCACCGGCGGCGGCGCGCCATCAGCAAGCGGTTGGGGGGAGGCTTCCTGCCCG

CGCTGATCCCCATCATCGCCGCGGCGATCGGGGCGATCCCCGGCATTGCTTCCGTGGCGGTGCAGGCCTCT

CAGCGCCACTGAGACACACTTGGAAACATCTTGTAATAAACCAATGGACTCTGACGCTCCTGGTCCTGTGA

TGTGTTTTCGTAGACAGATGGAAGACATCAATTTTTCGTCCCTGGCTCCGCGACACGGCACGCGGCCGTTCA

TGGGCACCTGGAGCGACATCGGCACCAGCCAACTGAACGGGGGCGCCTTCAATTGGAGCAGTCTCTGGAG

CGGGCTTAAGAATTTCGGGTCCACGCTTAAAACCTATGGCAGCAAGGCGTGGAACAGCACCACAGGGCAG

GCGCTGAGGGATAAGCTGAAAGAGCAGAACTTCCAGCAGAAGGTGGTCGATGGGCTCGCCTCGGGCATCA

ACGGGGTGGTGGACCTGGCCAACCAGGCCGTGCAGCGGCAGATCAACAGCCGCCTGGACCCGGTGCCGCC

CGCCGGCTCCGTGGAGATGCCGCAGGTGGAGGAGGAGCTGCCTCCCCTGGACAAGCGGGGCGAGAAGCGA

CCCCGCCCCGATGCGGAGGAGACGCTGCTGACGCACACGGACGAGCCGCCCCCGTACGAGGAGGCGGTGA

AACTGGGTCTGCCCACCACGCGGCCCATCGCGCCCCTGGCCACCGGGGTGCTGAAACCCGAAAAGCCCGCG

ACCCTGGACTTGCCTCCTCCCCAGCCTTCCCGCCCCTCTACAGTGGCTAAGCCCCTGCCGCCGGTGGCCGTG

GCCCGCGCGCGACCCGGGGGCACCGCCCGCCCTCATGCGAACTGGCAGAGCACTCTGAACAGCATCGTGG

GTCTGGGAGTGCAGAGTGTGAAGCGCCGCCGCTGCTATTAAACCTACCGTAGCGCTTAACTTGCTTGTCTGT

GTGTGTATGTATTATGTCGCCGCCGCCGCTGTCCACCAGAAGGAGGAGTGAAGAGGCGCGTCGCCGAGTTG

CAAGATGGCCACCCCATCGATGCTGCCCCAGTGGGCGTACATGCACATCGCCGGACAGGACGCTTCGGAGT

ACCTGAGTCCGGGTCTGGTGCAGTTTGCCCGCGCCACAGACACCTACTTCAGTCTGGGGAACAAGTTTAGG

AACCCCACGGTGGCGCCCACGCACGATGTGACCACCGACCGCAGCCAGCGGCTGACGCTGCGCTTCGTGCC

CGTGGACCGCGAGGACAACACCTACTCGTACAAAGTGCGCTACACGCTGGCCGTGGGCGACAACCGCGTG

CTGGACATGGCCAGCACCTACTTTGACATCCGCGGCGTGCTGGATCGGGGCCCTAGCTTCAAACCCTACTC

CGGCACCGCCTACAACAGTCTGGCCCCCAAGGGAGCACCCAACACTTGTCAGTGGACATATAAAGCCGATG

GTGAAACTGCCACAGAAAAAACCTATACATATGGAAATGCACCCGTGCAGGGCATTAACATCACAAAAGA

TGGTATTCAACTTGGAACTGACACCGATGATCAGCCAATCTACGCAGATAAAACCTATCAGCCTGAACCTC

AAGTGGGTGATGCTGAATGGCATGACATCACTGGTACTGATGAAAAGTATGGAGGCAGAGCTCTTAAGC CT

GATACCAAAATGAAGCCTTGTTATGGTTCTTTTGCCAAGCCTACTAATAAAGAAGGAGGTCAGGCAAATGT

GAAAACAGGAACAGGCACTACTAAAGAATATGACATAGACATGGCTTTCTTTGACAACAGAAGTGCGGCT

GCTGCTGGCCTAGCTCCAGAAATTGTTTTGTATACTGAAAATGTGGATTGGAAACTCCAGATACCCATATT

GTATACAAAGCAGGCACAGATGACAGCAGCTCTTCTATTAATTTGGGTCAGCAAGCCATGCCCAACAGACC

TAACTACATTGGTTTCAGAGACAACTTTATCGGGCTCATGTACTACAACAGCACTGGCAATATGGGGGTGC

TGGCCGGTCAGGCTTCTCAGCTGAATGCTGTGGTTGACTTGCAAGACAGAAACACCGAGCTGTCCTACCAG

CTCTTGCTTGACTCTCTGGGTGACAGAACCCGGTATTTCAGTATGTGGAATCAGGCGGTGGACAGCTATGAT
```

-continued

```
CCTGATGTGCGCATTATTGAAAATCATGGTGTGGAGGATGAACTTCCCAACTATTGTTTCCCTCTGGATGCT
GTTGGCAGAACAGATACTTATCAGGGAATTAAGGCTAATGGAACTGATCAAACCACATGGACCAAAGATG
ACAGTGTCAATGATGCTAATGAGATAGGCAAGGGTAATCCATTCGCCATGGAAATCAACATCCAAGCCAAC
CTGTGGAGGAACTTCCTCTACGCCAACGTGGCCCTGTACCTGCCCGACTCTTACAAGTACACGCCGGCCAA
TGTTACCCTGCCCACAACACCAACACCTACGATTACATGAACGGCCGGGTGGTGGCGCCCTCGCTGGTGG
ACTCCTACATCAACATCGGGGCGCGCTGGTCGCTGGATCCCATGGACAACGTGAACCCCTTCAACCACCAC
CGCAATGCGGGGCTGCGCTACCGCTCCATGCTCCTGGGCAACGGGCGCTACGTGCCCTTCCACATCCAGGT
GCCCCAGAAATTTTTCGCCATCAAGAGCCTCCTGCTCCTGCCCGGGTCCTACACCTACGAGTGGAACTTCCG
CAAGGACGTCAACATGATCCTGCAGAGCTCCCTCGGCAACGACCTGCGCACGGACGGGGCCTCCATCTCCT
TCACCAGCATCAACCTCTACGCCACCTTCTTCCCCATGGCGCACAACACGGCCTCCACGCTCGAGGCCATGC
TGCGCAACGACACCAACGACCAGTCCTTCAACGACTACCTCTCGGCGGCCAACATGCTCTACCCCATCCCG
GCCAACGCCACCAACGTGCCCATCTCCATCCCCTCGCGCAACTGGGCCGCCTTCCGCGGCTGGTCCTTCACG
CGTCTCAAGACCAAGGAGACGCCCTCGCTGGGCTCCGGGTTCGACCCCTACTTCGTCTACTCGGGCTCCATC
CCCTACCTCGACGGCACCTTCTACCTCAACCACACCTTCAAGAAGGTCTCCATCACCTTCGACTCCTCCGTC
AGCTGGCCCGGCAACGACCGGCTCCTGACGCCCAACGAGTTCGAAATCAAGCGCACCGTCGACGGCGAGG
GCTACAACGTGGCCCAGTGCAACATGACCAAGGACTGGTTCCTGGTCCAGATGCTGGCCCACTACAACATC
GGCTACCAGGGCTTCTACGTGCCCGAGGGCTACAAGGACCGCATGTACTCCTTCTTCCGCAACTTCCAGCCC
ATGAGCCGCCAGGTGGTGGACGAGGTCAACTACAAGGACTACCAGGCCGTCACCCTGGCCTACCAGCACA
ACAACTCGGGCTTCGTCGGCTACCTCGCGCCCACCATGCGCCAGGGCCAGCCCTACCCCGCCAACTACCCC
TACCCGCTCATCGGCAAGAGCGCCGTCACCAGCGTCACCCAGAAAAAGTTCCTCTGCGACAGGGTCATGTG
GCGCATCCCCTTCTCCAGCAACTTCATGTCCATGGGCGCGCTCACCGACCTCGGCCAGAACATGCTCTATGC
CAACTCCGCCCACGCGCTAGACATGAATTTCGAAGTCGACCCCATGGATGAGTCCACCCTTCTCTATGTTGT
CTTCGAAGTCTTCGACGTCGTCCGAGTGCACCAGCCCCACCGCGGCGTCATCGAGGCCGTCTACCTGCGCA
CCCCCTTCTCGGCCGGTAACGCCACCACCTAAGCTCTTGCTTCTTGCAAGCCATGGCCGCGGGCTCCGGCGA
GCAGGAGCTCAGGGCCATCATCCGCGACCTGGGCTGCGGGCCCTACTTCCTGGGCACCTTCGATAAGCGCT
TCCCGGGATTCATGGCCCCGCACAAGCTGGCCTGCGCCATCGTCAACACGGCCGGCCGCGAGACCGGGGGC
GAGCACTGGCTGGCCTTCGCCTGGAACCCGCGCTCGAACACCTGCTACCTCTTCGACCCCTTCGGGTTCTCG
GACGAGCGCCTCAAGCAGATCTACCAGTTCGAGTACGAGGGCCTGCTGCGCCGCAGCGCCCTGGCCACCGA
GGACCGCTGCGTCACCCTGGAAAAGTCCACCCAGACCGTGCAGGGTCCGCGCTCGGCCGCCTGCGGGCTCT
TCTGCTGCATGTTCCTGCACGCCTTCGTGCACTGGCCCGACCGCCCCATGGACAAGAACCCCACCATGAACT
TGCTGACGGGGGTGCCCAACGGCATGCTCCAGTCGCCCCAGGTGGAACCCACCCTGCGCCGCAACCAGGA
GGCGCTCTACCGCTTCCTCAACTCCCACTCCGCCTACTTCGCTCCCACCGCGCGCGCATCGAGAAGGCCAC
CGCCTTCGACCGCATGAATCAAGACATGTAAACCGTGTGTGTATGTTAAATGTCTTTAATAAACAGCACTTT
CATGTTACACATGCATCTGAGATGATTTATTTAGAAATCGAAAGGGTTCTGCCGGGTCTCGGCATGGCCCGC
GGGCAGGACACGTTGCGGAACTGGTACTTGGCCAGCCACTTGAACTCGGGGATCAGCAGTTTGGGCAGCG
GGGTGTCGGGGAAGGAGTCGGTCCACAGCTTCCGCGTCAGTTGCAGGGCGCCCAGCAGGTCGGGCGCGGA
GATCTTGAAATCGCAGTTGGGACCCGCGTTCTGCGCGCGGGAGTTGCGGTACACGGGGTTGCAGCACTGGA
ACACCATCAGGGCCGGGTGCTTCACGCTCGCCAGCACCGTCGCGTCGGTGATGCTCTCCACGTCGAGGTCC
TCGGCGTTGGCCATCCCGAAGGGGGTCATCTTGCAGGTCTGCCTTCCCATGGTGGGCACGCACCCGGGCTT
GTGGTTGCAATCGCAGTGCAGGGGGATCAGCATCATCTGGGCCTGGTCGGCGTTCATCCCCGGGTACATGG
```

-continued

```
CCTTCATGAAAGCCTCCAATTGCCTGAACGCCTGCTGGGCCTTGGCTCCCTCGGTGAAGAAGACCCCGCAG

GACTTGCTAGAGAACTGGTTGGTGGCGCACCCGGCGTCGTGCACGCAGCAGCGCGCGTCGTTGTTGGCCAG

CTGCACCACGCTGCGCCCCAGCGGTTCTGGGTGATCTTGGCCCGGTCGGGGTTCTCCTTCAGCGCGCGCTG

CCCGTTCTCGCTCGCCACATCCATCTCGATCATGTGCTCCTTCTGGATCATGGTGGTCCCGTGCAGGCACCG

CAGCTTGCCCTCGGCCTCGGTGCACCCGTGCAGCCACAGCGCGCACCCGGTGCACTCCCAGTTCTTGTGGG

CGATCTGGGAATGCGCGTGCACGAAGCCCTGCAGGAAGCGCTCCCATCATGGTGGTCAGGGTCTTGTTGCTA

GTGAAGGTCAGCGGAATGCCGCGGTGCTCCTCGTTGATGTACAGGTGGCAGATGCGGCGGTACACCTCGCC

CTGCTCGGGCATCAGCTGGAAGTTGGCTTTCAGGTCGGTCTCCACGCGGTAGCGGTCCATCAGCATAGTCAT

GATTTCCATACCCTTCTCCCAGGCCGAGACGATGGGCAGGCTCATAGGGTTCTTCACCATCATCTTAGCGCT

AGCAGCCGCGGCCAGGGGGTCGCTCTCGTCCAGGGTCTCAAAGCTCCGCTTGCCGTCCTTCTCGGTGATCC

GCACCGGGGGGTAGCTGAAGCCCACGGCCGCCAGCTCCTCCTCGGCCTGTCTTTCGTCCTCGCTGTCCTGGC

TGACGTCCTGCAGGACCACATGCTTGGTCTTGCGGGGTTTCTTCTTGGGCGGCAGCGGCGGCGGAGATGTT

GGAGATGGCGAGGGGGAGCGCGAGTTCTCGCTCACCACTACTATCTCTTCCTCTTCTTGGTCCGAGGCCAC

GCGGCGGTAGGTATGTCTCTTCGGGGGCAGAGGCGGAGGCGACGGGCTCTCGCCGCCGCGACTTGGCGGA

TGGCTGGCAGAGCCCCTTCCGCGTTCGGGGGTGCGCTCCCGGCGGCGCTCTGACTGACTTCCTCCGCGGCC

GGCCATTGTGTTCTCCTAGGGAGGAACAACAAGCATGGAGACTCAGCCATCGCCAACCTCGCCATCTGCCC

CCACCGCCGACGAGAAGCAGCAGCAGCAGAATGAAAGCTTAACCGCCCCGCCGCCCAGCCCCGCCACCTC

CGACGCGGCCGTCCCAGACATGCAAGAGATGGAGGAATCCATCGAGATTGACCTGGGCTATGTGACGCCC

GCGGAGCACGAGGAGGAGCTGGCAGTGCGCTTTTCACAAGAAGAGATACACCAAGAACAGCCAGAGCAG

GAAGCAGAGAATGAGCAGAGTCAGGCTGGGCTCGAGCATGACGGCGACTACCTCCACCTGAGCGGGGGGG

AGGACGCGCTCATCAAGCATCTGGCCCGGCAGGCCACCATCGTCAAGGATGCGCTGCTCGACCGCACCGAG

GTGCCCCTCAGCGTGGAGGAGCTCAGCCGCGCCTACGAGTTGAACCTCTTCTCGCCGCGCGTGCCCCCCAA

GCGCCAGCCCAATGGCACCTGCGAGCCCAACCCGCGCCTCAACTTCTACCCGGTCTTCGCGGTGCCCGAGG

CCCTGGCCACCTACCACATCTTTTTCAAGAACCAAAAGATCCCCGTCTCCTGCCGCGCCAACCGCACCCGCG

CCGACGCCCTTTTCAACCTGGGTCCCGGCGCCCGCCTACCTGATATCGCCTCCTTGGAAGAGGTTCCCAAGA

TCTTCGAGGGTCTGGGCAGCGACGAGACTCGGGCCGCGAACGCTCTGCAAGGAGAAGGAGGAGAGCATGA

GCACCACAGCGCCCTGGTCGAGTTGGAAGGCGACAACGCGCGGCTGGCGGTGCTCAAACGCACGGTCGAG

CTGACCCATTTCGCCTACCCGGCTCTGAACCTGCCCCCCAAAGTCATGAGCGCGGTCATGGACCAGGTGCT

CATCAAGCGCGCGTCGCCCATCTCCGAGGACGAGGGCATGCAAGACTCCGAGGAGGGCAAGCCCGTGGTC

AGCGACGAGCAGCTGGCCCGGTGGCTGGGTCCTAATGCTAGTCCCCAGAGTTTGGAAGAGCGGCGCAAAC

TCATGATGGCCGTGGTCCTGGTGACCGTGGAGCTGGAGTGCCTGCGCCGCTTCTTCGCCGACGCGGGAGACC

CTGCGCAAGGTCGAGGAGAACCTGCACTACCTCTTCAGGCACGGGTTCGTGCGCCAGGCCTGCAAGATCTC

CAACGTGGAGGTGACCAACCTGGTCTCCTACATGGGCATCTTGCACGAGAACCGCCTGGGGCAGAACGTGC

TGCACACCACCCTGCGCGGGGAGGCCCGGCGCGACTACATCCGCGACTGCGTCTACCTCTACCTCTGCCAC

ACCTGGCAGACGGGCATGGGCGTGTGGCAGCAGTGTCTGGAGGAGCAGAACCTGAAAGAGCTCTGCAAGC

TCCTGCAGAAGAACCTCAAGGGTCTGTGGACCGGGTTCGACGAGCGCACCACCGCCTCGGACCTGGCCGAC

CTCATTTTCCCCGAGCGCCTCAGGCTGACGCTGCGCAACGGCCTGCCCGACTTTATGAGCCAAAGCATGTTG

CAAAACTTTCGCTCTTTCATCCTCGAACGCTCCGGAATCCTGCCCGCCACCTGCTCCGCGCTGCCCTCGGAC

TTCGTGCCGCTGACCTTCCGCGAGTGCCCCCCGCCGCTGTGGAGCCACTGCTACCTGCTGCGCCTGGCCAAC

TACCTGGCCTACCACTCGGACGTGATCGAGGACGTCAGCGGCGAGGGCCTGCTCGAGTGCCACTGCCGCTG

CAACCTCTGCACGCCGCACCGCTCCCTGGCCTGCAACCCCCAGCTGCTGAGCGAGACCCAGATCATCGGCA
```

-continued

```
CCTTCGAGTTGCAAGGGCCCAGCGAAGGCGAGGGTTCAGCCGCCAAGGGGGGTCTGAAACTCACCCCGGG

GCTGTGGACCTCGGCCTACTTGCGCAAGTTCGTGCCCGAGGACTACCATCCCTTCGAGATCAGGTTCTACGA

GGACCAATCCCATCCGCCCAAGGCCGAGCTGTCGGCCTGCGTCATCACCCAGGGGGCGATCCTGGCCCAAT

TGCAAGCCATCCAGAAATCCCGCCAAGAATTCTTGCTGAAAAAGGGCCGCGGGGTCTACCTCGACCCCCAG

ACCGGTGAGGAGCTCAACCCCGGCTTCCCCCAGGATGCCCCGAGGAAACAAGAAGCTGAAAGTGGAGCTG

CCGCCCGTGGAGGATTTGGAGGAAGACTGGGAGAACAGCAGTCAGGCAGAGGAGGAGGAGATGGAGGAA

GACTGGGACAGCACTCAGGCAGAGGAGGACAGCCTGCAAGACAGTCTGGAGGAAGACGACGAGGAGGCA

GAGGAGGAGGTGGAAGAAGCAGCCGCCGCCAGACCGTCGTCCTCGGCGGGGGAGAAAGCAAGCAGCACG

GATACCATCTCCGCTCCGGGTCGGGGTCCCGCTCGACCACACAGTAGATGGGACGAGACCGGACGATTCCC

GAACCCCACCACCCAGACCGGTAAGAAGGAGCGGCAGGGATACAAGTCCTGGCGGGGGCACAAAAACGC

CATCGTCTCCTGCTTGCAGGCCTGCGGGGCAACATCTCCTTCACCCGGCGCTACCTGCTCTTCCACCGCGG

GGTGAACTTTCCCCGCAACATCTTGCATTACTACCGTCACCTCCACAGCCCCTACTACTTCCAAGAAGAGGC

AGCAGCAGCAGAAAAAGACCAGCAGAAAACCAGCAGCTAGAAAATCCACAGCGGCGGCAGCAGGTGGAC

TGAGGATCGCGGCGAACGAGCCGGCGCAAACCCGGGAGCTGAGGAACCGGATCTTTCCCACCCTCTATGCC

ATCTTCCAGCAGAGTCGGGGGCAGGAGCAGGAACTGAAAGTCAAGAACCGTTCTCTGCGCTCGCTCACCCG

CAGTTGTCTGTATCACAAGAGCGAAGACCAACTTCAGCGCACTCTCGAGGACGCCGAGGCTCTCTTCAACA

AGTACTGCGCGCTCACTCTTAAAGAGTAGCCCGCGCCCGCCCAGTCGCAGAAAAAGGCGGGAATTACGTCA

CCTGTGCCCTTCGCCCTACCGCCTCCACCCATCATCATGAGCAAAGAGATTCCCACGCCTTACATGTGGAG

CTACCAGCCCCAGATGGGCCTGGCCGCCGGTGCCGCCCACGACTACTCCACCCGCATGAATTGGCTCAGCG

CCGGGCCCGCGATGATCTCACGGGTGAATGACATCCGCGCCCACCGAAACCAGATACTCCTAGAACAGTCA

GCGCTCACCGCCACGCCCCGCAATCACCTCAATCCGCGTAATTGGCCCGCCGCCCTGGTGTACCAGGAAAT

TCCCCAGCCCACGACCGTACTACTTCCGCGAGACGCCCAGGCCGAAGTCCAGCTGACTAACTCAGGTGTCC

AGCTGGCGGGCGGCGCCACCCTGTGTCGTCACCGCCCCGCTCAGGGTATAAAGCGGCTGGTGATCCGGGGC

AGAGGCACACAGCTCAACGACGAGGTGGTGAGCTCTTCGCTGGGTCTGCGACCTGACGGAGTCTTCCAACT

CGCCGGATCGGGGAGATCTTCCTTCACGCCTCGTCAGGCCGTCCTGACTTTGGAGAGTTCGTCCTCGCAGCC

CCGCTCGGGTGGCATCGGCACTCTCCAGTTCGTGGAGGAGTTCACTCCCTCGGTCTACTTCAACCCCTTCTC

CGGCTCCCCCGGCCACTACCCGGACGAGTTCATCCCGAACTTCGACGCCATCAGCGAGTCGGTGGACGGCT

ACGATTGAAACTAATCACCCCCTTATCCAGTGAAATAAAGATCATATTGATGATGATTTTACAGAAATAAA

AAATAATCATTTGATTTGAAATAAAGATACAATCATATTGATGATTTGAGTTTAACAAAAAAATAAAGAAT

CACTTACTTGAAATCTGATACCAGGTCTCTGTCCATGTTTTCTGCCAACACCACTTCACTCCCTCTTCCCAG

CTCTGGTACTGCAGGCCCCGGCGGGCTGCAAACTTCCTCCACACGCTGAAGGGGATGTCAAATTCCTCCTG

TCCCTCAATCTTCATTTTATCTTCTATCAGATGTCCAAAAAGCGCGTCCGGGTGGATGATGACTTCGACCCC

GTCTACCCCTACGATGCAGACAACGCACCGACCGTGCCCTTCATCAACCCCCCCTTCGTCTCTTCAGATGGA

TTCCAAGAGAAGCCCCTGGGGGTGTTGTCCCTGCGACTGGCCGACCCCGTCACCACCAAGAACGGGGAAAT

CACCCTCAAGCTGGGAGAGGGGTGGACCTCGATTCCTCGGGAAAACTCATCTCCAACACGGCCACCAAG

GCCGCCGCCCCTCTCAGTTTTTCCAACAACACCATTTCCCTTAACATGGATCACCCCTTTTACACTAAAGAT

GGAAAATTATCCTTACAAGTTTCTCCACCATTAAATATACTGAGAACAAGCATTCTAAACACACTAGCTTTA

GGTTTTGGATCAGGTTTAGGACTCCGTGGCTCTGCCTTGGCAGTACAGTTAGTCTCTCCACTTACATTTGAT

ACTGATGGAAACATAAAGCTTACCTTAGACAGAGGTTTGCATGTTACAACAGGAGATGCAATTGAAAGCAA

CATAAGCTGGGCTAAAGGTTTAAAATTTGAAGATGGAGCCATAGCAACCAACATTGGAAATGGGTTAGAGT
```

-continued

```
TTGGAAGCAGTAGTACAGAAACAGGTGTTGATGATGCTTACCCAATCCAAGTTAAACTTGGATCTGGCCTT

AGCTTTGACAGTACAGGAGCCATAATGGCTGGTAACAAAGAAGACGATAAACTCACTTTGTGGACAACACC

TGATCCATCACCAAACTGTCAAATACTCGCAGAAAATGATGCAAAACTAACACTTTGCTTGACTAAATGTG

GTAGTCAAATACTGGCCACTGTGTCAGTCTTAGTTGTAGGAAGTGGAAACCTAAACCCCATTACTGGCACC

GTAAGCAGTGCTCAGGTGTTTCTACGTTTTGATGCAAACGGTGTTCTTTTAACAGAACATTCTACACTAAAA

AAATACTGGGGTATAGGCAGGGAGATAGCATAGATGGCACTCCATATACCAATGCTGTAGGATTCATGCC

CAATTTAAAAGCTTATCCAAAGTCACAAAGTTCTACTACTAAAAATAATATAGTAGGGCAAGTATACATGA

ATGGAGATGTTTCAAAACCTATGCTTCTCACTATAACCCTCAATGGTACTGATGACAGCAACAGTACATATT

CAATGTCATTTTCATACACCTGGACTAATGGAAGCTATGTTGGAGCAACATTTGGGGCTAACTCTTATACCT

TCTCATACATCGCCCAAGAATGAACACTGTATCCCACCCTGCATGCCAACCCTTCCCACCCCACTCTGTGGA

ACAAACTCTGAAACACAAATAAAATAAAGTTCAAGTGTTTTATTGATTCAAACAGTTTTACAGGATTCGAG

CAGTTATTTTTCCTCCACCCTCCCAGGACATGGAATACACCACCCTCTCCCCCCGCACAGCCTTGAACATCT

GAATGCCATTGGTGATGGACATGCTTTTGGTCTCCACGTTCCACACAGTTTCAGAGCGAGCCAGTCTCGGGT

CGGTCAGGGAGATGAAACCCTCCGGGCACTCCCGCATCTGCACCTCACAGCTCAACAGCTGAGGATTGTCC

TCGGTGGTCGGGATCACGGTTATCTGGAAGAAGCAGAAGAGCGGCGGTGGGAATCATAGTCCGCGAACGG

GATCGGCCGGTGGTGTCGCATCAGGCCCCGCAGCAGTCGCTGCCGCCGCCGCTCCGTCAAGCTGCTGCTCA

GGGGGTCCGGGTCCAGGGACTCCCTCAGCATGATGCCCACGCCCTCAGCATCAGTCGTCTGGTGCGGCGG

GCGCAGCAGCGCATGCGGATCTCGCTCAGGTCGCTGCAGTACGTGCAACACAGAACCACCAGGTTGTTCAA

CAGTCCATAGTTCAACACGCTCCAGCCGAAACTCATCGCGGGAAGGATGCTACCCACCGTGGCCGTCGTACC

AGATCCTCAGGTAAATCAAGTGGTGCCCCCTCCAGAACACGCTGCCCACGTACATGATCTCCTTGGGCATG

TGGCGGTTCACCACCTCCCGGTACCACATCACCCTCTGGTTGAACATGCAGCCCGATGATCCTGCGGAA

CCACAGGGCCAGCACCGCCCCGCCCGCCATGCAGCGAAGAGACCCCGGGTCCCGGCAATGGCAATGGAGG

ACCCACCGCTCGTACCCGTGGATCATCTGGGAGCTGAACAAGTCTATGTTGGCACAGCACAGGCATATGCT

CATGCATCTCTTCAGCACTCTCAACTCCTCGGGGGTCAAAACCATATCCCAGGGCACGGGGAACTCTTGCA

GGACAGCGAACCCCGCAGAACAGGGCAATCCTCGCACAGAACTTACATTGTGCATGGACAGGGTATCGCA

ATCAGGCAGCACCGGGTGATCCTCCACCAGAGAAGCGCGGGTCTCGGTCTCCTCACAGCGTGGTAAGGGG

GCCGGCCGATACGGGTGATGGCGGACGCGGCTGATCGTGTTCGCGACCGTGTCATGATGCAGTTGCTTTC

GGACATTTTCGTACTTGCTGTAGCAGAACCTGGTCCGGGCGCTGCACACCGATCGCCGGCGGCGGTCTCGG

CGCTTGGAACGCTCGGTGTTGAAATTGTAAAACAGCCACTCTCTCAGACCGTGCAGCAGATCTAGGGCCTC

AGGAGTGATGAAGATCCCATCATGCCTGATGGCTCTGATCACATCGACCACCGTGGAATGGGCCAGACCAC

GCCAGATGATGCAATTTTGTTGGGTTTCGGTGACGGCGGGGGAGGGAAGAACAGGAAGAACCATGATTAA

CTTTTAATCCAAACGGTCTCGGAGTACTTCAAAATGAAGATCGCGGAGATGGCACCTCTCGCCCCCGCTGT

GTTGGTGGAAAATAACAGCCAGGTCAAAGGTGATACGGTTCTCGAGATGTTCCACGGTGGCTTCCAGCAAA

GCCTCCACGCGCACATCCAGAAACAAGACAATAGCGAAAGCGGGAGGGTTCTCTAATTCCTCAATCATCAT

GTTACACTCCTGCACCATCCCCAGATAATTTTCATTTTTCCAGCCTTGAATGATTCGAACTAGTTCCTGAGGT

AAATCCAAGCCAGCCATGATAAAGAGCTCGCGCAGAGCGCCCTCCACCGGCATTCTTAAGCACACCCTCAT

AATTCCAAGATATTCTGCTCCTGGTTCACCTGCAGCAGATTGACAAGCGGAATATCAAAATCTCTGCCGCG

ATCCCTGAGCTCCTCCCTCAGCAATAACTGTAAGTACTCTTTCATATCCTCTCCGAAATTTTTAGCCATAGG

ACCACCAGGAATAAGATTAGGGCAAGCCACAGTACAGATAAACCGAAGTCCTCCCCAGTGAGCATTGCCA

AATGCAAGACTGCTATAAGCATGCTGGCTAGACCCGGTGATATCTTCCAGATAACTGGACAGAAAATCGCC

CAGGCAATTTTTAAGAAAATCAACAAAAGAAAAATCCTCCAGGTGGACGTTTAGAGCCTCGGGAACAACG
```

```
ATGAAGTAAATGCAAGCGGTGCGTTCCAGCATGGTTAGTTAGCTGATCTGTAGAAAAAACAAAAATGAAC

ATTAAACCATGCTAGCCTGGCGAACAGGTGGGTAAATCGTTCTCTCCAGCACCAGGCAGGCCACGGGGTCT

CCGGCGCGACCCTCGTAAAAATTGTCGCTATGATTGAAAACCATCACAGAGAGACGTTCCCGGTGGCCGGC

GTGAATGATTCCACAAGATGAATACACCCCCGGAACATTGGCGTCCGCGAGTGAAAAAAAGCGCCCGAGG

AAGCAATAAGGCACTACAATGCTCAGTCTCAAGTCCAGCAAAGCGATGCCATGCGGATGAAGCACAAAAT

TCTCAGGTGCGTACAAAATGTAATTACTCCCCTCCTGCACAGGCAGCAAAGCCCCCGATCCCTCCAGGTAC

ACATACAAAGCCTCAGCGTCCATAGCTTACCGAGCAGCAGCACACAACAGGCGCAAGAGTCAGAGAAAGG

CTGAGCTCTAACCTGTCCACCCGCTCTCTGCTCAATATATAGCCCAGATCTACACTGACGTAAAGGCCAAA

GTCTAAAAATACCCGCCAAATAATCACACACGCCCAGCACACGCCCAGAAACCGGTGACACACTCAAAAA

AATACGCGCACTTCCTCAAACGCCCAAAACTGCCGTCATTTCCGGGTTCCCACGCTACGTCATCAAAACAC

GACTTTCAAATTCCGTCGACCGTTAAAAACGTCACCCGCCCCGCCCCTAACGGTCGCCCGTCTCTCAGCCAA

TCAGCGCCCCGCATCCCCAAATTCAAACACCTCATTTGCATATTAACGCGCACAAAAAGTTTGAGGTATATT

ATTGATGATG

ChAdV68-TETo-TSNA (SEQ ID NO: 67)
CCATCTTCAATAATATACCTCAAACTTTTTGTGCGCGTTAATATGCAAATGAGGCGTTTGAATTTGGGGAGG

AAGGGCGGTGATTGGTCGAGGGATGAGCGACCGTTAGGGGCGGGGCGAGTGACGTTTTGATGACGTGGTT

GCGAGGAGGAGCCAGTTTGCAAGTTCTCGTGGGAAAAGTGACGTCAAACGAGGTGTGGTTTGAACACGGA

AATACTCAATTTTCCCGCGCTCTCTGACAGGAAATGAGGTGTTTCTGGGCGGATGCAAGTGAAAACGGGCC

ATTTTCGCGCGAAAACTGAATGAGGAAGTGAAAATCTGAGTAATTTCGCGTTTATGGCAGGGAGGAGTATT

TGCCGAGGGCCGAGTAGACTTTGACCGATTACGTGGGGGTTTCGATTACCGTGTTTTTCACCTAAATTTCCG

CGTACGGTGTCAAAGTCCGGTGTTTTTACGTAGGTGTCAGCTGATCGCCAGGGTATTTAAACCTGCGCTCTC

CAGTCAAGAGGCCACTCTTGAGTGCCAGCGAGAAGAGTTTTCTCCTCCGCGCCGCGAGTCAGATCTACACT

TTGAAAGTAGGGATAACAGGGTAATCCATGTTGACATTGATTATTGACTAGTTATTAAAGTACTTCCCTATC

AGTGATAGAGAAAAGTGAAAGTCGAGTTTACCACTCCCTATCAGTGATAGAGAAAAGTGAAAGTCGAGTTT

ACCACTCCCTATCAGTGATAGAGAAAAGTGAAAGTCGAGTTTACCACTCCCTATCAGTGATAGAAAAAGT

GAAAGTCGAGTTTACCACTCCCTATCAGTGATAGAGAAAAGTGAAAGTCGAGTTTACCACTCCCTATCAGT

GATAGAGAAAAGTGAAAGTCGAGTTTACCACTCCCTATCAGTGATAGAGAAAAGTGAAAGTCGAGCTCGG

TACCCGGGTCGAGGTAGGCGTGTACGGTGGGAGGCCTATATAAGCAGAGCTCGTTTAGTGAACCGTCAGAT

CGCCTGGAGACGCCATCCACGCTGTTTTGACCTCCATAGAAGACAGCGATCGCGCCACCATGGCTGGCATG

ACCGAGTACAAGCTAGTCGTTGTGGGAGCTGGAGATGTGGGCAAATCTGCTCTGACCATTCAGCTGATTCA

GGGCACAGATCTGGATCACCAGGAGAAGTGTCTGAGCAGGCTGTACGACCACATGCCAGAAGGATTAACC

CCTCTTATGGGAGTGAGCTCTTCTTCTGCTCTGGCCAGACTGGGACTGCCTATGGATAAGCTGAACAAGATC

ACAGCTCCTGCCTCTCAGAAACTGAGACAGCTGCAGAAGATGGAGACCCCTGAACTGCTGCCTTGTGGATA

TCTGGTGGAGGAGAATACCACAATCAGCGTGACCGTGAAAGGCCTGGAAGCCCAGAACAAGATCAAAGGC

TGTACCGGCTCTGTGAATATGACACTGCAGAGAGCTTCTGCCGCCCCTAAGACAGGAGGAGGAGGAGAAG

CTGCTGCCTACAATAATACATTAGTGGCCAGACATGTGCCCCAGATCCCTAAGCCTGACAGCCTGGTTGGC

CTGAGCGATGAATTAGGAAAAAGAGACACATTTGCCGAGAGCCTGATCCGGAGAATGGCCTCTGCCGGCT

ACCTGTTCCTGGATATCATCACATATGTTGTGTTTGCCGTGACCTTCGTGCTGGGAGTTCTGGGCGGCCTGA

ATACCGAGACCAATGAAAAAGCTCTTGAAGCCGTGTTTGGCAAGTACGGCAGAATCGTGGAGGTGCTGGG

CGGCAGATCTTGTGAAGAATTAACAGCTGTGTTACCACCTCCTCAGCTGCTTGGCAGACGGTTCAACTTCTT

CAGCTACAGCTACGTTGCTGCTGGCTCTTCTGGCAACAACTACGACCTGATGGCCCAGCCTATTACACCTGG
```

-continued

```
ACCTGATACAACACCTCTGCCTGTGACCGATACATCTTCTGTGTCTACCGGACACGCCACATCTCTGCCAGT
GACAGATGCTGGACTGAGAGTGACAGAGTCTAAAGGACACAGCGATTCTTGGCACCTGAGCCTGGATACA
GCCATCAGGGTGAATACCCCTAAGCTGGTTTCTGAAGTGGAAGAGCTGAACAAGAGCATCACCGCCCTGAG
GGAGAAGTTACTGCAGATGGTGGAAGCCGATAGACCTGGAAACCTGTTTATTGGAGGCCTGAACACCGAG
ACCAATGAGGACTCTCCCGTGAAGGATGAAGTGGTGGTGAACGATCAATGGGGCCAGAATTGTAGCTGCC
ATCATGGAGGCTACGAGTTCCCTGATCTGCACAGGACAATCGTGTCTGAGTGCGATGTGTATCTGACCTAC
ATGCTGAGACAGGCTGCTCTGCAGCTGTTCTTCGACCTGTATCACAGCATCCCTAGCAGCTTTTCTCCTCTG
GTTCTGAGCTGTCTGGTGCAGCCTCTGGAAGATGTGGAAGTGATGGAGAAGGATGGCACAACCTTTAGCTG
TGAGGTGAGCCACGATGAGGTGCCTCGGACATATGGACCCGTGTTTATGTGTCTGGGAGGACTGCTGACCA
TGGTGGCTGGAGCTGTTTGGCTGACAGTTGGACCCGGACCAGGCGCCAAATTTGTTGCTGCTTGGACACTG
AAAGCTGCTGCTGGGCCCGGACCAGGCCAGTACATCAAGGCCAACTCTAAGTTTATCGGCATCACCGAATT
GGGACCTGGACCCGGCTAGTAGTGAGTTTAAACTCCCATTTAAATGTGAGGGTTAATGCTTCGAGCAGACA
TGATAAGATACATTGATGAGTTTGGACAAACCACAACTAGAATGCAGTGAAAAAATGCTTTATTTGTGAA
ATTTGTGATGCTATTGCTTTATTTGTAACCATTATAAGCTGCAATAAACAAGTTAACAACAACAATTGCATT
CATTTTATGTTTCAGGTTCAGGGGAGATGTGGGAGGTTTTTAAAGCAAGTAAAACCTCTACAAATGTGGT
AAAATAACTATAACGGTCCTAAGGTAGCGAGTGAGTAGTGTTCTGGGGCGGGGAGGACCTGCATGAGGG
CCAGAATAACTGAAATCTGTGCTTTTCTGTGTGTTGCAGCAGCATGAGCGGAAGCGGCTCCTTTGAGGGAG
GGGTATTCAGCCCTTATCTGACGGGGCGTCTCCCCTCCTGGGCGGGAGTGCGTCAGAATGTGATGGGATCC
ACGGTGGACGGCCGGCCCGTGCAGCCCGCGAACTCTTCAACCCTGACCTATGCAACCCTGAGCTCTTCGTC
GTTGGACGCAGCTGCCGCCGCAGCTGCTGCATCTGCCGCCAGCGCCGTGCGCGGAATGGCCATGGGCGCCG
GCTACTACGGCACTCTGGTGCCAACTCGAGTTCCACCAATAATCCCGCCAGCCTGAACGAGGAGAAGCTG
TTGCTGCTGATGGCCCAGCTCGAGGCCTTGACCCAGCGCCTGGGCGAGCTGACCCAGCAGGTGGCTCAGCT
GCAGGAGCAGACGCGGGCCGCGGTTGCCACGGTGAAATCCAAATAAAAAATGAATCAATAAATAAACGGA
GACGGTTGTTGATTTTAACACAGAGTCTGAATCTTTATTTGATTTTTCGCGCGCGGTAGGCCCTGGACCACC
GGTCTCGATCATTGAGCACCCGGTGGATCTTTTCCAGGACCCGGTAGAGGTGGGCTTGGATGTTGAGGTAC
ATGGGCATGAGAGCCCGTCCCGGGGGTGGAGGTAGCTCCATTGCAGGGCCTCGTGCTCGGGGGTGGTGTTGTA
AATCACCCAGTCATAGCAGGGGCGCAGGGCATGGTGTTGCACAATATCTTTGAGGAGGAGACTGATGGCCA
CGGGCAGCCCTTTGGTGTAGGTGTTTACAAATCTGTTGAGCTGGGAGGGATGCATGCGGGGGGAGATGAGG
TGCATCTTGGCCTGGATCTTGAGATTGGCGATGTTACCGCCCAGATCCCGCCTGGGGTTCATGTTGTGCAGG
ACCACCAGCACGGTGTATCCGGTGCACTTGGGGAATTTATCATGCAACTTGGAAGGGAAGGCGTGAAAGA
ATTTGGCGACGCCTTTGTGCCCGCCCAGGTTTTCCATGCACTCATCCATGATGATGGCGATGGGCCCGTGGG
CGGCGGCCTGGGCAAAGACGTTTCGGGGGTCGGACACATCATAGTTGTGGTCCTGGGTGAGGTCATCATAG
GCCATTTTAATGAATTTGGGGCGGAGGGTGCCGGACTGGGGACAAAGGTACCCTCGATCCCGGGGCGTA
GTTCCCCTCACAGATCTGCATCTCCCAGGCTTTGAGCTCGGAGGGGGGATCATGTCCACCTGCGGGCGA
TAAAGAACACGGTTTCCGGGCGGGGAGATGAGCTGGGCCGAAAGCAAGTTCCGGAGCAGCTGGGACTT
GCCGCAGCCGGTGGGGCCGTAGATGACCCCGATGACCGGCTGCAGGTGGTAGTTGAGGGAGAGACAGCTG
CCGTCCTCCCGGAGGAGGGGGCCACCTCGTTCATCATCTCGCGCACGTGCATGTTCTCGCGCACCAGTTCC
GCCAGGAGGCGCTCTCCCCCCAGGGATAGGAGCTCCTGGAGCGAGGCGAAGTTTTTCAGCGGCTTGAGTCC
GTCGGCCATGGGCATTTTGGAGAGGGTTTGTTGCAAGAGTTCCAGGCGGTCCCAGAGCTCGGTGATGTGCT
CTACGGCATCTCGATCCAGCAGACCTCCTCGTTTCGCGGGTTGGGACGGCTGCGGGAGTAGGGCACCAGAC
```

-continued

```
GATGGGCGTCCAGCGCAGCCAGGGTCCGGTCCTTCCAGGGTCGCAGCGTCCGCGTCAGGGTGGTCTCCGTC

ACGGTGAAGGGGTGCGCGCCGGGCTGGGCGCTTGCGAGGGTGCGCTTCAGGCTCATCCGGCTGGTCGAAA

ACCGCTCCCGATCGGCGCCCTGCGCGTCGGCCAGGTAGCAATTGACCATGAGTTCGTAGTTGAGCGCCTCG

GCCGCGTGGCCTTTGGCGCGGAGCTTACCTTTGGAAGTCTGCCCGCAGGCGGACAGAGGAGGGACTTGAG

GGCGTAGAGCTTGGGGGCGAGGAAGACGGACTCGGGGGCGTAGGCGTCCGCGCCGCAGTGGGCGCAGACG

GTCTCGCACTCCACGAGCCAGGTGAGGTCGGGCTGGTCGGGGTCAAAAACCAGTTTCCCGCCGTTCTTTTTG

ATGCGTTTCTTACCTTTGGTCTCCATGAGCTCGTGTCCCCGCTGGGTGACAAAGAGGCTGTCCGTGTCCCCG

TAGACCGACTTTATGGGCCGGTCCTCGAGCGGTGTGCCGCGGTCCTCCTCGTAGAGGAACCCCGCCCACTC

CGAGACGAAAGCCCGGGTCCAGGCCAGCACGAAGGAGGCCACGTGGGACGGGTAGCGGTCGTTGTCCACC

AGCGGGTCCACCTTTTCCAGGGTATGCAAACACATGTCCCCCTCGTCCACATCCAGGAAGGTGATTGGCTT

GTAAGTGTAGGCCACGTGACCGGGGGTCCCGGCCGGGGGGGTATAAAAGGGTGCGGGTCCCTGCTCGTCCT

CACTGTCTTCCGGATCGCTGTCCAGGAGCGCCAGCTGTTGGGGTAGGTATTCCCTCTCGAAGGCGGGCATG

ACCTCGGCACTCAGGTTGTCAGTTTCTAGAAACGAGGAGGATTTGATATTGACGGTGCCGGCGGAGATGCC

TTTCAAGAGCCCCTCGTCCATCTGGTCAGAAAAGACGATCTTTTTGTTGTCGAGCTTGGTGGCGAAGGAGCC

GTAGAGGGCGTTGGAGAGGAGCTTGGCGATGGAGCGCATGGTCTGGTTTTTTTCCTTGTCGGCGCGCTCCTT

GGCGGCGATGTTGAGCTGCACGTACTCGCGCGCCACGCACTTCCATTCGGGGAAGACGGTGGTCAGCTCGT

CGGGCACGATTCTGACCTGCCAGCCCCGATTATGCAGGGTGATGAGGTCCACACTGGTGGCCACCTCGCCG

CGCAGGGGCTCATTAGTCCAGCAGAGGCGTCCGCCCTTGCGCGAGCAGAAGGGGGGCAGGGGGTCCAGCA

TGACCTCGTCGGGGGGGTCGGCATCGATGGTGAAGATGCCGGGCAGGAGGTCGGGGTCAAAGTAGCTGAT

GGAAGTGGCCAGATCGTCCAGGGCAGCTTGCCATTCGCGCACGGCCAGCGCGCGCTCGTAGGGACTGAGG

GGCGTGCCCCAGGGCATGGGATGGGTAAGCGCGGAGGCGTACATGCCGCAGATGTCGTAGACGTAGAGGG

GCTCCTCGAGGATGCCGATGTAGGTGGGGTAGCAGCGCCCCCCGCGGATGCTGGCGCGCACGTAGTCATAC

AGCTCGTGCGAGGGGGCGAGGAGCCCCGGGCCCAGGTTGGTGCGACTGGGCTTTTCGGCGCGGTAGACGA

TCTGGCGGAAAATGGCATGCGAGTTGGAGGAGATGGTGGGCCTTTGGAAGATGTTGAAGTGGGCGTGGGG

CAGTCCGACCGAGTCGCGGATGAAGTGGGCGTAGGAGTCTTGCAGCTTGGCGACGAGCTCGGCGGTGACTA

GGACGTCCAGAGCGCAGTAGTCGAGGGTCTCCTGGATGATGTCATACTTGAGCTGTCCCTTTTGTTTCCACA

GCTCGCGGTTGAGAAGGAACTCTTCGCGGTCCTTCCAGTACTCTTCGAGGGGGAACCCGTCCTGATCTGCA

CGGTAAGAGCCTAGCATGTAGAACTGGTTGACGGCCTTGTAGGCGCAGCAGCCCTTCTCCACGGGGAGGGC

GTAGGCCTGGGCGGCCTTGCGCAGGGAGGTGTGCGTGAGGGCGAAAGTGTCCCTGACCATGACCTTGAGG

AACTGGTGCTTGAAGTCGATATCGTCGCAGCCCCCCTGCTCCCAGAGCTGGAAGTCCGTGCGCTTCTTGTAG

GCGGGGTTGGGCAAAGCGAAAGTAACATCGTTGAAGAGGATCTTGCCCGCGCGGGGCATAAAGTTGCGAG

TGATGCGGAAAGGTTGGGGCACCTCGGCCCGGTTGTTGATGACCTGGGCGGCGAGCACGATCTCGTCGAAG

CCGTTGATGTTGTGGCCCACGATGTAGAGTTCCACGAATCGCGGACGGCCCTTGACGTGGGGCAGTTTCTTG

AGCTCCTCGTAGGTGAGCTCGTCGGGGTCGCTGAGCCCGTGCTGCTCGAGCGCCCAGTCGGCGAGATGGGG

GTTGGCGCGGAGGAAGGAAGTCCAGAGATCCACGGCCAGGGCGGTTTGCAGACGGTCCCGGTACTGACGG

AACTGCTGCCCGACGGCCATTTTTTCGGGGGTGACGCAGTAGAAGGTGCGGGGTCCCCGTGCCAGCGATC

CCATTTGAGCTGGAGGGCGAGATCGAGGGCGAGCTCGACGAGCCGGTCGTCCCCGGAGAGTTTCATGACC

AGCATGAAGGGGACGAGCTGCTTGCCGAAGGACCCCATCCAGGTGTAGGTTTCCACATCGTAGGTGAGGA

AGAGCCTTTCGGTGCGAGGATGCGAGCCGATGGGGAAGAACTGGATCTCCTGCCACCAATTGGAGGAATG

GCTGTTGATGTGATGGAAGTAGAAATGCCGACGGCGCGCCGAACACTCGTGCTTGTGTTTATACAAGCGGC

CACAGTGCTCGCAACGCTGCACGGGATGCACGTGCTGCACGAGCTGTACCTGAGTTCCTTTGACGAGGAAT
```

-continued

```
TTCAGTGGGAAGTGGAGTCGTGGCGCCTGCATCTCGTGCTGTACTACGTCGTGGTGGTCGGCCTGGCCCTCT

TCTGCCTCGATGGTGGTCATGCTGACGAGCCCGCGCGGGAGGCAGGTCCAGACCTCGGCGCGAGCGGGTCG

GAGAGCGAGGACGAGGGCGCGCAGGCCGGAGCTGTCCAGGGTCCTGAGACGCTGCGGAGTCAGGTCAGTG

GGCAGCGGCGGCGCGCGGTTGACTTGCAGGAGTTTTTCCAGGGCGCGCGGGAGGTCCAGATGGTACTTGAT

CTCCACCGCGCCATTGGTGGCGACGTCGATGGCTTGCAGGGTCCGTGCCCCTGGGGTGTGACCACCGTCC

CCCGTTTCTTCTTGGGCGGCTGGGGCGACGGGGGCGGTGCCTCTTCCATGGTTAGAAGCGGCGGCGAGGAC

GCGCGCCGGGCGGCAGGGGCGGCTCGGGGCCCGGAGGCAGGGGCGGCAGGGGCACGTCGGCGCCGCGCG

CGGGTAGGTTCTGGTACTGCGCCCGGAGAAGACTGGCGTGAGCGACGACGCGACGGTTGACGTCCTGGATC

TGACGCCTCTGGGTGAAGGCCACGGGACCCGTGAGTTTGAACCTGAAAGAGAGTTCGACAGAATCAATCTC

GGTATCGTTGACGGCGCCTGCCGCAGGATCTCTTGCACGTCGCCCGAGTTGTCCTGGTAGGCGATCTCGGT

CATGAACTGCTCGATCTCCTCCTCTTGAAGGTCTCCGCGGCCGGCGCGCTCCACGGTGGCCGCGAGGTCGTT

GGAGATGCGGCCCATGAGGTGCGAGAAGGCGTTCATGCCCGCCTCGTTCCAGACGCGGCTGTAGACCACGA

CGCCCTCGGGATCGCGGGCGCGCATGACCACCTGGGCGAGGTTGAGCTCCACGTGGCGCGTGAAGACCGC

GTAGTTGCAGAGGCGCTGGTAGAGGTAGTTGAGCGTGGTGGCGATGTGCTCGGTGACGAAGAAATACATG

ATCCAGCGGCGGAGCGGCATCTCGCTGACGTCGCCCAGCGCCTCCAAACGTTCCATGGCCTCGTAAAAGTC

CACGGCGAAGTTGAAAAACTGGGAGTTGCGCGCCGAGACGGTCAACTCCTCCTCCAGAAGACGGATGAGC

TCGGCGATGGTGGCGCGCACCTCGCGCTCGAAGGCCCCCGGGAGTTCCTCCACTTCCTCTTCTTCCTCCTCC

ACTAACATCTCTTCTACTTCCTCCTCAGGCGGCAGTGGTGGCGGGGGAGGGGCCTGCGTCGCCGGCGGCG

CACGGGCAGACGGTCGATGAAGCGCTCGATGGTCTCGCCGCGCCGGCGTCGCATGGTCTCGGTGACGGCGC

GCCCGTCCTCGCGGGCCGCAGCGTGAAGACGCCGCCGCGCATCTCCAGGTGGCCGGGGGGGTCCCCGTTG

GGCAGGGAGAGGGCGCTGACGATGCATCTTATCAATTGCCCCGTAGGGACTCCGCGCAAGGACCTGAGCG

TCTCGAGATCCACGGGATCTGAAAACCGCTGAACGAAGGCTTCGAGCCAGTCGCAGTCGCAAGGTAGGCT

GAGCACGGTTTCTTCTGGCGGGTCATGTTGGTTGGGAGCGGGGCGGGCGATGCTGCTGGTGATGAAGTTGA

AATAGGCGGTTCTGAGACGGCGGATGGTGGCGAGGAGCACCAGGTCTTTGGGCCCGGCTTGCTGGATGCGC

AGACGGTCGGCCATGCCCCAGGCGTGGTCCTGACACCTGGCCAGGTCCTTGTAGTAGTCCTGCATGAGCCG

CTCCACGGGCACCTCCTCCTCGCCCGCGCGGCCGTGCATGCGCGTGAGCCCGAAGCCGCGCTGGGGCTGGA

CGAGCGCCAGGTCGGCGACGACGCGCTCGGCGAGGATGGCTTGCTGGATCTGGGTGAGGGTGGTCTGGAA

GTCATCAAAGTCGACGAAGCGGTGGTAGGCTCCGGTGTTGATGGTGTAGGAGCAGTTGGCCATGACGGACC

AGTTGACGGTCTGGTGGCCCGGACGCACGAGCTCGTGGTACTTGAGGCGCGAGTAGGCGCGCGTGTCGAAG

ATGTAGTCGTTGCAGGTGCGCACCAGGTACTGGTAGCCGATGAGGAAGTGCGGCGGCGGCTGGCGGTAGA

GCGGCCATCGCTCGGTGGCGGGGCGCCGGGCGCGAGGTCCTCGAGCATGGTGCGGTGGTAGCCGTAGAT

GTACCTGGACATCCAGGTGATGCCGGCGGCGGTGGTGGAGGCGCGCGGGAACTCGCGGACGCGGTTCCAG

ATGTTGCGCAGCGGCAGGAAGTAGTTCATGGTGGGCACGGTCTGGCCCGTGAGGCGCGCGCAGTCGTGGAT

GCTCTATACGGGCAAAAACGAAAGCGGTCAGCGGCTCGACTCCGTGGCCTGGAGGCTAAGCGAACGGGTT

GGGCTGCGCGTGTACCCCGGTTCGAATCTCGAATCAGGCTGGAGCCGCAGCTAACGTGGTATTGGCACTCC

CGTCTCGACCCAAGCCTGCACCAACCCTCCAGGATACGGAGGCGGGTCGTTTTGCAACTTTTTTTGGAGGC

CGGATGAGACTAGTAAGCGCGGAAAGCGGCCGACCGCGATGGCTCGCTGCCGTAGTCGGAGAAGAATCG

CCAGGGTTGCGTTGCGGTGTGCCCCGGTTCGAGGCCGGCCGGATTCCGCGGCTAACGAGGGCGTGGCTGCC

CCGTCGTTTCCAAGACCCCATAGCCAGCCGACTTCTCCAGTTACGGAGCGAGCCCCTCTTTTGTTTTGTTTGT

TTTTGCCAGATGCATCCCGTACTGCGGCAGATGCGCCCCCACCACCCTCCACCGCAACAACAGCCCCCTCC
```

-continued

ACAGCCGGCGCTTCTGCCCCCGCCCCAGCAGCAACTTCCAGCCACGACCGCCGCGGCCGCCGTGAGCGGGG
CTGGACAGAGTTATGATCACCAGCTGGCCTTGGAAGAGGGCGAGGGGCTGGCGCGCCTGGGGCGTCGTC
GCCGGAGCGGCACCCGCGCGTGCAGATGAAAAGGGACGCTCGCGAGGCCTACGTGCCCAAGCAGAACCTG
TTCAGAGACAGGAGCGGCGAGGAGCCCGAGGAGATGCGCGCGGCCCGGTTCCACGCGGGGCGGGAGCTGC
GGCGCGGCCTGGACCGAAAGAGGGTGCTGAGGGACGAGGATTTCGAGGCGGACGAGCTGACGGGGATCAG
CCCCGCGCGCGCACGTGGCCGCGGCCAACCTGGTCACGGCGTACGAGCAGACCGTGAAGGAGGAGAGC
AACTTCCAAAAATCCTTCAACAACCACGTGCGCACCCTGATCGCGCGCGAGGAGGTGACCCTGGGCCTGAT
GCACCTGTGGGACCTGCTGGAGGCCATCGTGCAGAACCCCACCAGCAAGCCGCTGACGGCGCAGCTGTTCC
TGGTGGTGCAGCATAGTCGGGACAACGAAGCGTTCAGGGAGGCGCTGCTGAATATCACCGAGCCCGAGGG
CCGCTGGCTCCTGGACCTGGTGAACATTCTGCAGAGCATCGTGGTGCAGGAGCGCGGGCTGCCGCTGTCCG
AGAAGCTGGCGGCCATCAACTTCTCGGTGCTGAGTTTGGGCAAGTACTACGCTAGGAAGATCTACAAGACC
CCGTACGTGCCCATAGACAAGGAGGTGAAGATCGACGGGTTTTACATGCGCATGACCCTGAAAGTGCTGAC
CCTGAGCGACGATCTGGGGGTGTACCGCAACGACAGGATGCACCGTGCGGTGAGCGCCAGCAGGCGGCGC
GAGCTGAGCGACCAGGAGCTGATGCATAGTCTGCAGCGGGCCCTGACCGGGGCCGGGACCGAGGGGGAGA
GCTACTTTGACATGGGCGCGGACCTGCACTGGCAGCCCAGCCGCCGGGCCTTGGAGGCGGCGGCAGGACC
CTACGTAGAAGAGGTGGACGATGAGGTGGACGAGGAGGGCGAGTACCTGGAAGACTGATGGCGCGACCGT
ATTTTTGCTAGATGCAACAACAACAGCCACCTCCTGATCCCGCGATGCGGGCGGCGCTGCAGAGCCAGCCG
TCCGGCATTAACTCCTCGGACGATTGGACCCAGGCCATGCAACGCATCATGGCGCTGACGACCCGCAACCC
CGAAGCCTTTAGACAGCAGCCCCAGGCCAACCGGCTCTCGGCCATCCTGGAGGCCGTGGTGCCCTCGCGCT
CCAACCCCACGCACGAGAAGGTCCTGGCCATCGTGAACGCGCTGGTGGAGAACAAGGCCATCCGCGGCGA
CGAGGCCGGCCTGGTGTACAACGCGCTGCTGGAGCGCGTGGCCCGCTACAACAGCACCAACGTGCAGACC
AACCTGGACCGCATGGTGACCGACGTGCGCGAGGCCGTGGCCCAGCGCGAGCGGTTCCACCGCGAGTCCA
ACCTGGGATCCATGGTGGCGCTGAACGCCTTCCTCAGCACCCAGCCCGCCAACGTGCCCCGGGGCCAGGAG
GACTACACCAACTTCATCAGCGCCCTGCGCCTGATGGTGACCGAGGTGCCCCAGAGCGAGGTGTACCAGTC
CGGGCCGGACTACTTCTTCCAGACCAGTCGCCAGGGCTTGCAGACCGTGAACCTGAGCCAGGCTTTCAAGA
ACTTGCAGGGCCTGTGGGGCGTGCAGGCCCCGGTCGGGACCGCGCGACGGTGTCGAGCCTGCTGACGCC
GAACTCGCGCCTGCTGCTGCTGGTGGCCCCCTTCACGGACAGCGGCAGCATCAACCGCAACTCGTACC
TGGGCTACCTGATTAACCTGTACCGCGAGGCCATCGGCCAGGCGCACGTGGACGAGCAGACCTACCAGGA
GATCACCCACGTGAGCCGCGCCCTGGGCCAGGACGACCCGGGCAACCTGGAAGCCACCCTGAACTTTTTGC
TGACCAACCGGTCGCAGAAGATCCCGCCCCAGTACGCGCTCAGCACCGAGGAGGAGCGCATCCTGCGTTAC
GTGCAGCAGAGCGTGGGCCTGTTCCTGATGCAGGAGGGGGCCACCCCCAGCGCCGCGCTCGACATGACCG
CGCGCAACATGGAGCCCAGCATGTACGCCAGCAACCGCCCGTTCATCAATAAACTGATGGACTACTTGCAT
CGGGCGGCCGCCATGAACTCTGACTATTTCACCAACGCCATCCTGAATCCCACTGGCTCCGCCGCCGGG
GTTCTACACGGGCGAGTACGACATGCCCGACCCCAATGACGGGTTCCTGTGGGACGATGTGGACAGCAGCG
TGTTCTCCCCCGACCGGGTGCTAACGAGCGCCCCTTGTGGAAGAAGGAAGGCAGCGACCGACGCCCGTCC
TCGGCGCTGTCCGGCCGCGAGGGTGCTGCCGCGGCGGTGCCCGAGGCCGCCAGTCCTTTCCCGAGCTTGCC
CTTCTCGCTGAACAGTATCCGCAGCAGCGAGCTGGGCAGGATCACGCGCCCGCGCTTGCTGGGCGAAGAGG
AGTACTTGAATGACTCGCTGTTGAGACCCGAGCGGGAGAAGAACTTCCCCAATAACGGGATAGAAAGCCT
GGTGGACAAGATGAGCCGCTGGAAGACGTATGCGCAGGAGCACAGGGACGATCCCCGGGCGTCGCAGGGG
GCCACGAGCCGGGGCAGCGCCGCCCGTAAACGCCGGTGGCACGACAGGCAGCGGGGACAGATGTGGGAC
GATGAGGACTCCGCCGACGACAGCAGCGTGTTGGACTTGGGTGGGAGTGGTAACCCGTTCGCTCACCTGCG

-continued

```
CCCCCGTATCGGGCGCATGATGTAAGAGAAACCGAAAATAAATGATACTCACCAAGGCCATGGCGACCAG

CGTGCGTTCGTTTCTTCTCTGTTGTTGTTGTATCTAGTATGATGAGGCGTGCGTACCCGGAGGGTCCTCCTCC

CTCGTACGAGAGCGTGATGCAGCAGGCGATGGCGGCGGCGGCGATGCAGCCCCCGCTGGAGGCTCCTTAC

GTGCCCCGCGGTACCTGGCGCCTACGGAGGGGCGGAACAGCATTCGTTACTCGGAGCTGGCACCCTTGTA

CGATACCACCCGGTTGTACCTGGTGGACAACAAGTCGGCGGACATCGCCTCGCTGAACTACCAGAACGACC

ACAGCAACTTCCTGACCACCGTGGTGCAGAACAATGACTTCACCCCCACGGAGGCCAGCACCCAGACCATC

AACTTTGACGAGCGCTCGCGGTGGGGCGGCCAGCTGAAAACCATCATGCACACCAACATGCCCAACGTGA

ACGAGTTCATGTACAGCAACAAGTTCAAGGCGCGGGTGATGGTCTCCCGCAAGACCCCCAATGGGGTGAC

AGTGACAGAGGATTATGATGGTAGTCAGGATGAGCTGAAGTATGAATGGGTGGAATTTGAGCTGCCCGAA

GGCAACTTCTCGGTGACCATGACCATCGACCTGATGAACAACGCCATCATCGACAATTACTTGGCGGTGGG

GCGGCAGAACGGGGTGCTGGAGAGCGACATCGGCGTGAAGTTCGACACTAGGAACTTCAGGCTGGGCTGG

GACCCCGTGACCGAGCTGGTCATGCCCGGGGTGTACACCAACGAGGCTTTCCATCCCGATATTGTCTTGCTG

CCCGGCTGCGGGGTGGACTTCACCGAGAGCCGCCTCAGCAACCTGCTGGGCATTCGCAAGAGGCAGCCCTT

CCAGGAAGGCTTCCAGATCATGTACGAGGATCTGGAGGGGGGCAACATCCCCGCGCTCCTGGATGTCGACG

CCTATGAGAAAAGCAAGGAGGATGCAGCAGCTGAAGCAACTGCAGCCGTAGCTACCGCCTCTACCGAGGT

CAGGGGCGATAATTTTGCAAGCGCCGCAGCAGTGGCAGCGGCCGAGGCGGCTGAAACCGAAAGTAAGATA

GTCATTCAGCCGGTGGAGAAGGATAGCAAGAACAGGAGCTACAACGTACTACCGGACAAGATAAACACCG

CCTACCGCAGCTGGTACCTAGCCTACAACTATGGCGACCCCGAGAAGGGCGTGCGCTCCTGGACGCTGCTC

ACCACCTCGGACGTCACCTGCGGCGTGGAGCAAGTCTACTGGTCGCTGCCCGACATGATGCAAGACCCGGT

CACCTTCCGCTCCACGCGTCAAGTTAGCAACTACCCGGTGGTGGGCGCCGAGCTCCTGCCCGTCTACTCCAA

GAGCTTCTTCAACGAGCAGGCCGTCTACTCGCAGCAGCTGCGCGCCTTCACCTCGCTTACGCACGTCTTCAA

CCGCTTCCCCGAGAACCAGATCCTCGTCCGCCCGCCCGCGCCCACCATTACCACCGTCAGTGAAAACGTTC

CTGCTCTCACAGATCACGGGACCCTGCCGCTGCGCAGCAGTATCCGGGGAGTCCAGCGCGTGACCGTTACT

GACGCCAGACGCCGCACCTGCCCCTACGTCTACAAGGCCCTGGGCATAGTCGCGCCGCGCGTCCTCTCGAG

CCGCACCTTCTAAATGTCCATTCTCATCTCGCCCAGTAATAACACCGGTTGGGGCCTGCGCGCGCCCAGCAA

GATGTACGGAGGCGCTCGCCAACGCTCCACGCAACACCCCGTGCGCGTGCGCGGGCACTTCCGCGCTCCCT

GGGGCGCCCTCAAGGGCCGCGTGCGGTCGCGCACCACCGTCGACGACGTGATCGACCAGGTGGTGGCCGA

CGCGCGCAACTACACCCCCGCCGCCGCGCCCGTCTCCACCGTGGACGCCGTCATCGACAGCGTGGTGGCCG

ACGCGCGCCGGTACGCCCGCGCCAAGAGCCGGCGGCGGCGCATCGCCCGGCGGCACCGGAGCACCCCCGC

CATGCGCGGCGCGAGCCTTGCTGCGCAGGGCCAGGCGCACGGGACGCAGGGCCATGCTCAGGGCGGCC

AGACGCGCGGCTTCAGGCGCCAGCGCCGGCAGGACCCGGAGACGCGCGGCCACGGCGGCGGCAGCGGCCA

TCGCCAGCATGTCCCGCCCGCGGCGAGGGAACGTGTACTGGGTGCGCGACGCCGCCACCGGTGTGCGCGTG

CCCGTGCGCACCCGCCCCCCTCGCACTTGAAGATGTTCACTTCGCGATGTTGATGTGTCCCAGCGGCGAGG

AGGATGTCCAAGCGCAAATTCAAGGAAGAGATGCTCCAGGTCATCGCGCCTGAGATCTACGGCCCTGCGGT

GGTGAAGGAGGAAAGAAAGCCCCGCAAAATCAAGCGGGTCAAAAAGGACAAAAAGGAAGAAGAAAGTGA

TGTGGACGGATTGGTGGAGTTTGTGCGCGAGTTCGCCCCCCGGCGGCGCGTGCAGTGGCGCGGGCGGAAGG

TGCAACCGGTGCTGAGACCCGGCACCACCGTGGTCTTCACGCCCGGCGAGCGCTCCGGCACCGCTTCCAAG

CGCTCCTACGACGAGGTGTACGGGGATGATGATATTCTGGAGCAGGCGGCCGAGCGCCTGGGCGAGTTTGC

TTACGGCAAGCGCAGCCGTTCCGCACCGAAGGAAGAGGCGGTGTCCATCCCGCTGGACCACGGCAACCCC

ACGCCGAGCCTCAAGCCCGTGACCTTGCAGCAGGTGCTGCCGACCGCGGCGCCGCGCCGGGGGTTCAAGC
```

-continued

```
GCGAGGGCGAGGATCTGTACCCCACCATGCAGCTGATGGTGCCCAAGCGCCAGAAGCTGGAAGACGTGCT

GGAGACCATGAAGGTGGACCCGGACGTGCAGCCCGAGGTCAAGGTGCGGCCCATCAAGCAGGTGGCCCCG

GGCCTGGGCGTGCAGACCGTGGACATCAAGATTCCCACGGAGCCCATGGAAACGCAGACCGAGCCCATGA

TCAAGCCCAGCACCAGCACCATGGAGGTGCAGACGGATCCCTGGATGCCATCGGCTCCTAGTCGAAGACCC

CGGCGCAAGTACGGCGCGGCCAGCCTGCTGATGCCCAACTACGCGCTGCATCCTTCCATCATCCCCACGCC

GGGCTACCGCGGCACGCGCTTCTACCGCGGTCATACCAGCAGCCGCCGCCGCAAGACCACCACTCGCCGCC

GCCGTCGCCGCACCGCCGCTGCAACCACCCCTGCCGCCCTGGTGCGGAGAGTGTACCGCCGCGGCCGCGCA

CCTCTGACCCTGCCGCGCGCGCGCTACCACCCCGAGCATCGCCATTTAAACTTTCGCCTGCTTTGCAGATCAA

TGGCCCTCACATGCCGCCTTCGCGTTCCCATTACGGGCTACCGAGGAAGAAAACCGCGCCGTAGAAGGCTG

GCGGGGAACGGGATGCGTCGCCACCACCACCGGCGGCGGCGCGCCATCAGCAAGCGGTTGGGGGGAGGCT

TCCTGCCCGCGCTGATCCCCATCATCGCCGCGGCGATCGGGGCGATCCCCGGCATTGCTTCCGTGGCGGTGC

AGGCCTCTCAGCGCCACTGAGACACACTTGGAAACATCTTGTAATAAACCAAATGGACTCTGACGCTCCTGG

TCCTGTGATGTGTTTTCGTAGACAGATGGAAGACATCAATTTTTCGTCCCTGGCTCCGCGACACGGCACGCG

GCCGTTCATGGGCACCTGGAGCGACATCGGCACCAGCCAACTGAACGGGGGCGCCTTCAATTGGAGCAGTC

TCTGGAGCGGGCTTAAGAATTTCGGGTCCACGCTTAAAACCTATGGCAGCAAGGCGTGGAACAGCACCACA

GGGCAGGCGCTGAGGGATAAGCTGAAAGAGCAGAACTTCCAGCAGAAGGTGGTCGATGGGCTCGCCTCGG

GCATCAACGGGGTGGTGGACCTGGCCAACCAGGCCGTGCAGCGGCAGATCAACAGCCGCCTGGACCCGGT

GCCGCCCGCCGGCTCCGTGGAGATGCCGCAGGTGGAGGAGGAGCTGCCTCCCCTGGACAAGCGGGGCGAG

AAGCGACCCCGCCCCGATGCGGAGGAGACGCTGCTGACGCACACGGACGAGCCGCCCCCGTACGAGGAGG

CGGTGAAACTGGGTCTGCCCACCACGCGGCCCATCGCGCCCCTGGCCACCGGGGTGCTGAAACCCGAAAA

GCCCGCGACCCTGGACTTGCCTCCTCCCCAGCCTTCCCGCCCCTCTACAGTGGCTAAGCCCCTGCCGCCGGT

GGCCGTGGCCCGCGCGCGACCCGGGGGCACCGCCCGCCCTCATGCGAACTGGCAGAGCACTCTGAACAGC

ATCGTGGGTCTGGGAGTGCAGAGTGTGAAGCGCCGCCGCTGCTATTAAACCTACCGTAGCGCTTAACTTGC

TTGTCTGTGTGTGTATGTATTATGTCGCCGCCGCCGCTGTCCACCAGAAGGAGGAGTGAAGAGGCGCGTCG

CCGAGTTGCAAGATGGCCACCCCATCGATGCTGCCCCAGTGGGCGTACATGCACATCGCCGGACAGGACGC

TTCGGAGTACTGAGTCCGGGTCTGGTGCAGTTTGCCCGCGCCACAGACACCTACTTCAGTCTGGGGAACA

AGTTTAGGAACCCCACGGTGGCGCCCACGCACGATGTGACCACCGACCGCAGCCAGCGGCTGACGCTGCG

CTTCGTGCCCGTGGACCGCGAGGACAACACCTACTCGTACAAAGTGCGCTACACGCTGGCCGTGGGCGACA

ACCGCGTGCTGGACATGGCCAGCACCTACTTTGACATCCGCGGCGTGCTGGATCGGGGCCCTAGCTTCAAA

CCCTACTCCGGCACCGCCTACAACAGTCTGGCCCCCAAGGGAGCACCCAACACTTGTCAGTGGACATATAA

AGCCGATGGTGAAACTGCCACAGAAAAAACCTATACATATGGAAATGCACCCGTGCAGGGCATTAACATC

ACAAAAGATGGTATTCAACTTGGAACTGACACCGATGATCAGCCAATCTACGCAGATAAAACCTATCAGCC

TGAACCTCAAGTGGGTGATGCTGAATGGCATGACATCACTGGTACTGATGAAAAGTATGGAGGCAGAGCTC

TTAAGCCTGATACCAAAATGAAGCCTTGTTATGGTTCTTTTGCCAAGCCTACTAATAAAGAAGGAGGTCAG

GCAAATGTGAAAACAGGAACAGGCACTACTAAAGAATATGACATAGACATGGCTTTCTTTGACAACAGAA

GTGCGGCTGCTGCTGGCCTAGCTCCAGAAATTGTTTGTATACTGAAAATGTGGATTTGGAAACTCCAGATA

CCCATATTGTATACAAAGCAGGCACAGATGACAGCAGCTTCTTCTATTAATTTGGGTCAGCAAGCCATGCCC

AACAGACCTAACTACATTGGTTTCAGAGACAACTTTATCGGGCTCATGTACTACAACAGCACTGGCAATAT

GGGGGTGCTGGCCGGTCAGGCTTCTCAGCTGAATGCTGTGGTTGACTTGCAAGACAGAAACACCGAGCTGT

CCTACCAGCTCTTGCTTGACTCTCTGGGTGACAGAACCCGGTATTTCAGTATGTGGAATCAGGCGGTGGACA

GCTATGATCCTGATGTGCGCATTATTGAAAATCATGGTGTGGAGGATGAACTTCCCAACTATTGTTTCCCTC
```

-continued

```
TGGATGCTGTTGGCAGAACAGATACTTATCAGGGAATTAAGGCTAATGGAACTGATCAAACCACATGGACC

AAAGATGACAGTGTCAATGATGCTAATGAGATAGGCAAGGGTAATCCATTCGCCATGGAAATCAACATCCA

AGCCAACCTGTGGAGGAACTTCCTCTACGCCAACGTGGCCCTGTACCTGCCCGACTCTTACAAGTACACOC

CGGCCAATGTTACCCTGCCCACCAACACCAACACCTACGATTACATGAACGGCCGGGTGGTGGCGCCCTCG

CTGGTGGACTCCTACATCAACATCGGGGCGCGCTGGTCGCTGGATCCCATGGACAACGTGAACCCCTTCAA

CCACCACCGCAATGCGGGGCTGCGCTACCGCTCCATGCTCCTGGGCAACGGGCGCTACGTGCCCTTCCACA

TCCAGGTGCCCCAGAAATTTTTCGCCATCAAGAGCCTCCTGCTCCTGCCCGGGTCCTACACCTACGAGTGGA

ACTTCCGCAAGGACGTCAACATGATCCTGCAGAGCTCCCTCGGCAACGACCTGCGCACGGACGGGGCCTCC

ATCTCCTTCACCAGCATCAACCTCTACGCCACCTTCTTCCCCATGGCGCACAACACGGCCTCCACGCTCGAG

GCCATGCTGCGCAACGACACCAACGACCAGTCCTTCAACGACTACCTCTCGGCGGCCAACATGCTCTACCC

CATCCCGGCCAACGCCACCAACGTGCCCATCTCCATCCCCTCGCGCAACTGGGCCGCCTTCCGCGGCTGGTC

CTTCACGCGTCTCAAGACCAAGGAGACGCCCTCGCTGGGCTCCGGGTTCGACCCCTACTTCGTCTACTCGGG

CTCCATCCCCTACCTCGACGGCACCTTCTACCTCAACCACACCTTCAAGAAGGTCTCCATCACCTTCGACTC

CTCCGTCAGCTGGCCCGGCAACGACCGGCTCCTGACGCCCAACGAGTTCGAAATCAAGCGCACCGTCGACG

GCGAGGGCTACAACGTGGCCCAGTGCAACATGACCAAGGACTGGTTCCTGGTCCAGATGCTGGCCCACTAC

AACATCGGCTACCAGGGCTTCTACGTGCCCGAGGGCTACAAGGACCGCATGTACTCCTTCTTCCGCAACTTC

CAGCCCATGAGCCGCCAGGTGGTGGACGAGGTCAACTACAAGGACTACCAGGCCGTCACCCTGGCCTACC

AGCACAACAACTCGGGCTTCGTCGGCTACCTCGCGCCCACCATGCGCCAGGGCCAGCCCTACCCCGCCAAC

TACCCCTACCCGCTCATCGGCAAGAGCGCCGTCACCAGCGTCACCCAGAAAAAGTTCCTCTGCGACAGGGT

CATGTGGCGCATCCCCTTCTCCAGCAACTTCATGTCCATGGGCGCGCTCACCGACCTCGGCCAGAACATGCT

CTATGCCAACTCCGCCCACGCGCTAGACATGAATTTCGAAGTCGACCCCATGGATGAGTCCACCCTTCTCTA

TGTTGTCTTCGAAGTCTTCGACGTCGTCCGAGTGCACCAGCCCCACCGCGGCGTCATCGAGGCCGTCTACCT

GCGCACCCCCTTCTCGGCCGGTAACGCCACCACCTAAGCTCTTGCTTCTTGCAAGCCATGGCCGCGGGCTCC

GGCGAGCAGGAGCTCAGGGCCATCATCCGCGACCTGGGCTGCGGGCCCTACTTCCTGGGCACCTTCGATAA

GCGCTTCCCGGGATTCATGGCCCCGCACAAGCTGGCCTGCGCCATCGTCAACACGGCCGCCGCGAGACCG

GGGGCGAGCACTGGCTGGCCTTCGCCTGGAACCCGCGCTCGAACACCTGCTACCTCTTCGACCCCCTTCGGG

TTCTCGGACGAGCGCCTCAAGCAGATCTACCAGTTCGAGTACGAGGGCCTGCTGCGCCGCAGCGCCCTGGC

CACCGAGGACCGCTGCGTCACCCTGGAAAAGTCCACCCAGACCGTGCAGGGTCCGCGCTCGGCCGCCTGCG

GGCTCTTCTGCTGCATGTTCCTGCACGCCTTCGTGCACTGGCCCGACCGCCCCATGGACAAGAACCCCACCA

TGAACTTGCTGACGGGGGTGCCCAACGGCATGCTCCAGTCGCCCCAGGTGGAACCCACCCTGCGCCGCAAC

CAGGAGGCGCTCTACCGCTTCCTCAACTCCCACTCCGCCTACTTTCGCTCCCACCGCGCGCGCATCGAGAAG

GCCACCGCCTTCGACCGCATGAATCAAGACATGTAAACCGTGTGTGTATGTTAAATGTCTTTAATAAACAG

CACTTTCATGTTACACATGCATCTGAGATGATTTATTTAGAAATCGAAAGGGTTCTGCCGGGTCTCGGCATG

GCCCGCGGGCAGGGACACGTTGCGGAACTGGTACTTGGCCAGCCACTTGAACTCGGGGATCAGCAGTTTGG

GCAGCGGGGTGTCGGGGAAGGAGTCGGTCCACAGCTTCCGCGTCAGTTGCAGGGCGCCCAGCAGGTCGGG

CGCGGAGATCTTGAAATCGCAGTTGGGACCCGCGTTCTGCGCGCGGGAGTTGCGGTACACGGGGTTGCAGC

ACTGGAACACCATCAGGGCCGGGTGCTTCACGCTCGCCAGCACCGTCGCGTCGGTGATGCTCTCCACGTCG

AGGTCCTCGGCGTTGGCCATCCCGAAGGGGGTCATCTTGCAGGTCTGCCTTCCCATGGTGGGCACGCACCC

GGGCTTGTGGTTGCAATCGCAGTCAGGGGGATCAGCATCATCTGGGCCTGGTCGGCGTTCATCCCCGGGT

ACATGGCCTTCATGAAAGCCTCCAATTGCCTGAACGCCTGCTGGGCCTTGGCTCCCTCGGTGAAGAAGACC
```

-continued

```
CCGCAGGACTTGCTAGAGAACTGGTTGGTGGCGCACCCGGCGTCGTGCACGCAGCAGCGCGCGTCGTTGTT

GGCCAGCTGCACCACGCTGCGCCCCCAGCGGTTCTGGGTGATCTTGGCCCGGTCGGGGTTCTCCTTCAGCGC

GCGCTGCCCGTTCTCGCTCGCCACATCCATCTCGATCATGTGCTCCTTCTGGATCATGGTGGTCCCGTGCAG

GCACCGCAGCTTGCCCTCGGCCTCGGTGCACCCGTGCAGCCACAGCGCGCACCCGGTGCACTCCCAGTTCT

TGTGGGCGATCTGGGAATGCGCGTGCACGAAAGCCCTGCAGGAAGCGGCCCATCATGGTGGTCAGGGTCTTG

TTGCTAGTGAAGGTCAGCGGAATGCCGCGGTGCTCCTCGTTGATGTACAGGTGGCAGATGCGGCGGTACAC

CTCGCCCTGCTCGGGCATCAGCTGGAAGTTGGCTTTCAGGTCGGTCTCCACGCGGTAGCGGTCCATCAGCAT

AGTCATGATTTCCATACCCTTCTCCCAGGCCGAGACGATGGGCAGGCTCATAGGGTTCTTCACCATCATCTT

AGCGCTAGCAGCCGCGGCCAGGGGGTCGCTCTCGTCCAGGGTCTCAAAGCTCCGCTTGCCGTCCTTCTCGG

TGATCCGCACCGGGGGGTAGCTGAAGCCCACGGCCGCCAGCTCCTCCTCGGCCTGTCTTTCGTCCTCGCTGT

CCTGGCTGACGTCCTGCAGGACCACATGCTTGGTCTTGCGGGGTTTCTTCTTGGGCGGCAGCGGCGGCGGA

GATGTTGGAGATGGCGAGGGGGAGCGCGAGTTCTCGCTCACCACTACTATCTCTTCCTCTTCTTGGTCCGAG

GCCACGCGGCGGTAGGTATGTCTCTTCGGGGGCAGAGGCGGAGGCGACGGGCTCTCGCCGCCGCGACTTG

GCGGATGGCTGGCAGAGCCCCTTCCGCGTTCGGGGGTGCGCTCCCGGCGGCGCTCTGACTGACTTCCTCCG

CGGCCGGCCATTGTGTTCTCCTAGGGAGGAACAACAAGCATGGAGACTCAGCCATCGCCAACCTCGCCATC

TGCCCCCACCGCCGACGAGAAGCAGCAGCAGCAGAATGAAAGCTTAACCGCCCCGCCGCCCAGCCCCGCC

ACCTCCGACGCGGCCGTCCCAGACATGCAAGAGATGGAGGAATCCATCGAGATTGACCTGGGCTATGTGAC

GCCCGCGGAGCACGAGGAGGAGCTGGCAGTGCGCTTTTCACAAGAAGAGATACACCAAGAACAGCCAGAG

CAGGAAGCAGAGAATGAGCAGAGTCAGGCTGGGCTCGAGCATGACGGCGACTACCTCCACCTGAGCGGGG

GGGAGGACGCGCTCATCAAGCATCTGGCCCGGCAGGCCACCATCGTCAAGGATGCGCTGCTCGACCGCACC

GAGGTGCCCCTCAGCGTGGAGGAGCTCAGCCGCGCCTACGAGTTGAACCTCTTCTCGCCGCGCGTGCCCCC

CAAGCGCCAGCCCAATGGCACCTGCGAGCCCAACCCGCGCCTCAACTTCTACCCGGTCTTCGCGGTGCCCG

AGGCCCTGGCCACCTACCACATCTTTTTCAAGAACCAAAAGATCCCCGTCTCCTGCCGCGCCAACCGCACC

CGCGCCGACGCCCTTTTCAACCTGGGTCCCGGCGCCCGCCTACCTGATATCGCCTCCTTGGAAGAGGTTCCC

AAGATCTTCGAGGGTCTGGGCAGCGACGAGATCGGGCCGCGAACGCTCTGCAAGGAGAAGGAGGAGAGC

ATGAGCACCACAGCGCCCTGGTCGAGTTGGAAGGCGACAACGCGCGGCTGGCGGTGCTCAAACGCACGGT

CGAGCTGACCCATTTCGCCTACCCGGCTCTGAACCTGCCCCCCAAAGTCATGAGCGCGGTCATGGACCAGG

TGCTCATCAAGCGCGCGTCGCCCATCTCCGAGGACGAGGGCATGCAAGACTCCGAGGAGGGCAAGCCCGT

GGTCAGCGACGAGCAGCTGGCCCGGTGGCTGGGTCCTAATGCTAGTCCCCAGAGTTTGGAAGAGCGGCGC

AAACTCATGATGGCCGTGGTCCTGGTGACCGTGGAGCTGGAGTGCCTGCGCCGCTTCTTCGCCGACGCGGA

GACCCTGCGCAAGGTCGAGGAGAACCTGCACTACCTCTTCAGGCACGGGTTCGTGCGCCAGGCCTGCAAGA

TCTCCAACGTGGAGCTGACCAACCTGGTCTCCTACATGGGCATCTTGCACGAGAACCGCCTGGGGCAGAAC

GTGCTGCACACCACCCTGCGCGGGGAGGCCCGGCGCGACTACATCCGCGACTGCGTCTACCTCTACCTCTG

CCACACCTGGCAGACGGGCATGGGCGTGTGGCAGCAGTGTCTGGAGGAGCAGAACCTGAAAGAGCTCTGC

AAGCTCCTGCAGAAGAACCTCAAGGGTCTGTGGACCGGGTTCGACGAGCGCACCACCGCCTCGGACCTGGC

CGACCTCATTTTCCCCGAGCGCCTCAGGCTGACGCTGCGCAACGGCCTGCCCGACTTTATGAGCCAAAGCA

TGTTGCAAAACTTTCGCTCTTTCATCCTCGAACGCTCCGGAATCCTGCCCGCCACCTGCTCCGCGCTGCCCT

CGGACTTCGTGCCGCTGACCTTCCGCGAGTGCCCCCGCCGCTGTGGAGCCACTGCTACCTGCTGCGCCTGG

CCAACTACCTGGCCTACCACTCGGACGTGATCGAGGACGTCAGCGGCGAGGGCCTGCTCGAGTGCCACTGC

CGCTGCAACCTCTGCACGCCGCACCGCTCCCTGGCCTGCAACCCCCAGCTGCTGAGCGAGACCCAGATCAT

CGGCACCTTCGAGTTGCAAGGGCCCAGCGAAGGCGAGGGTTCAGCCGCCAAGGGGGGTCTGAAACTCACC
```

```
CCGGGGCTGTGGACCTCGGCCTACTTGCGCAAGTTCGTGCCCGAGGACTACCATCCCTTCGAGATCAGGTT
CTACGAGGACCAATCCCATCCGCCCAAGGCCGAGCTGTCGGCCTGCGTCATCACCCAGGGGCGATCCTGG
CCCAATTGCAAGCCATCCAGAAATCCCGCCAAGAATTCTTGCTGAAAAAGGGCCGCGGGGTCTACCTCGAC
CCCCAGACCGGTGAGGAGCTCAACCCCGGCTTCCCCCAGGATGCCCCGAGGAAACAAGAAGCTGAAAGTG
GAGCTGCCGCCCGTGGAGGATTTGGAGGAAGACTGGGAGAACAGCAGTCAGGCAGAGGAGGAGGAGATG
GAGGAAGACTGGGACAGCACTCAGGCAGAGGAGGACAGCCTGCAAGACAGTCTGGAGGAAGACGAGGAG
GAGGCAGAGGAGGAGGTGGAAGAAGCAGCCGCCGCCAGACCGTCGTCCTCGGCGGGGGAGAAAGCAAGC
AGCACGGATACCATCTCCGCTCCGGGTCGGGGTCCCGCTCGACCACACAGTAGATGGGACGAGACCGGAC
GATTCCCGAACCCCACCACCCAGACCGGTAAGAAGGAGCGGCAGGGATACAAGTCCTGGCGGGGGCACAA
AAACGCCATCGTCTCCTGCTTGCAGGCCTGCGGGGCAACATCTCCTTCACCCGGCGCTACCTGCTCTTCCA
CCGCGGGGTGAACTTTCCCCGCAACATCTTGCATTACTACCGTCACCTCCACAGCCCCTACTACTTCCAAGA
AGAGGCAGCAGCAGCAGAAAAAGACCAGCAGAAAACCAGCAGCTAGAAAATCCACAGCGGCGGCAGCAG
GTGGACTGAGGATCGCGGCGAACGAGCCGGCGCAAACCCGGGAGCTGAGGAACCGGATCTTTCCCACCCT
CTATGCCATCTTCCAGCAGAGTCGGGGGCAGGAGCAGGAACTGAAAGTCAAGAACCGTTCTCTGCGCTCGC
TCACCCGCAGTTGTCTGTATCACAAGAGCGAAGACCAACTTCAGCGCACTCTCGAGGACGCCGAGGCTCTC
TTCAACAAGTACTGCGCGCTCACTCTTAAAGAGTAGCCCGCGCCCGCCCAGTCGCAGAAAAAGGCGGGAAT
TACGTCACCTGTGCCCTTCGCCCTAGCCGCCTCCACCCATCATCATGAGCAAAGAGATTCCCACGCCTTACA
TGTGGAGCTACCAGCCCCAGATGGGCCTGGCCGCCGGTGCCGCCCAGGACTACTCCACCCGCATGAATTGG
CTCAGCGCCGGGCCCGCGATGATCTCACGGGTGAATGACATCCGCGCCCACCGAAACCAGATACTCCTAGA
ACAGTCAGCGCTCACCGCCACGCCCCGCAATCACCTCAATCCGCGTAATTGGCCCGCCGCCCTGGTGTACC
AGGAAATTCCCCAGCCCACGACCGTACTACTTCCGCGAGACGCCCAGGCCGAAGTCCAGCTGACTAACTCA
GGTGTCCAGCTGGCGGGCGGCGCCACCCTGTGTCGTCACCGCCCCGCTCAGGGTATAAAGCGGCTGGTGAT
CCGGGGCAGAGGCACACAGCTCAACGACGAGGTGGTGAGCTCTTCGCTGGGTCTGCGACCTGACGGAGTCT
TCCAACTCGCCGGATCGGGGAGATCTTCCTTCACGCCTCGTCAGGCCGTCCTGACTTTGGAGAGTTCGTCCT
CGCAGCCCCGCTCGGGTGGCATCGGCACTCTCCAGTTCGTGGAGGAGTTCACTCCCTCGGTCTACTTCAACC
CCTTCTCCGGCTCCCCCGGCCACTACCCGGACGAGTTCATCCCGAACTTCGACGCCATCAGCGAGTCGGTG
GACGGCTACGATTGAAACTAATCACCCCCTTATCCAGTGAAATAAAGATCATATTGATGATGATTTTACAG
AAATAAAAAATAATCATTTGATTTGAAATAAAGATACAATCATATTGATGATTTGAGTTTAACAAAAAAAT
AAAGAATCACTTACTTGAAATCTGATACCAGGTCTCTGTCCATGTTTTCTGCCAACACCACTTCACTCCCCT
CTTCCCAGCTCTGGTACTGCAGGCCCCGGCGGGCTGCAAACTTCCTCCACACGCTGAAGGGGATGTCAAAT
TCCTCCTGTCCCTCAATCTTCATTTTATCTTCTATCAGATCCAAAAAGCGCGTCCGGGTGGATGATGACTT
CGACCCCGTCTACCCCTACGATGCAGACAACGCACCGACCGTGCCCTTCATCAACCCCCCCTTCGTCTCTTC
AGATGGATTCCAAGAGAAGCCCCTGGGGGTGTTGTCCCTGCGACTGGCCGACCCCGTCACCACCAAGAACG
GGGAAATCACCCTCAAGCTGGGAGAGGGGGTGGACCTCGATTCCTCGGGAAAACTCATCTCCAACACGGC
CACCAAGGCCGCCGCCCCTCTCAGTTTTTCCAACAACACCATTTCCCTTAACATGGATCACCCCTTTTACAC
TAAAGATGGAAAATTATCCTTACAAGTTTCTCCACCATTAAATATACTGAGAACAAGCATTCTAAACACAC
TAGCTTTAGGTTTTGGATCAGGTTTAGGACTCCGTGGCTCTGCCTTGGCAGTACAGTTAGTCTCTCCACTTAC
ATTTGATACTGATGGAAACATAAAGCTTACCTTAGACAGAGGTTTGCATGTTACAACAGGAGATGCAATTG
AAAGCAACATAAGCTGGGCTAAAGGTTTAAAATTTGAAGATGGAGCCATAGCAACCAACATTGGAAATGG
GTTAGAGTTTGGAAGCAGTAGTACAGAAACAGGTGTTGATGATGCTTACCCAATCCAAGTTAAACTTGGAT
```

-continued

```
CTGGCCTTAGCTTTGACAGTACAGGAGCCATAATGGCTGGTAACAAAGAAGACGATAAACTCACTTTGTGG
ACAACACCTGATCCATCACCAAACTGTCAAATACTCGCAGAAAATGATGCAAAACTAACACTTTGCTTGAC
TAAATGTGGTAGTCAAATACTGGCCACTGTGTCAGTCTTAGTTGTAGGAAGTGGAAACCTAAACCCCATTA
CTGGCACCGTAAGCAGTGCTCAGGTGTTTCTACGTTTTGATGCAAACGGTGTTCTTTTAACAGAACATTCTA
CACTAAAAAAATACTGGGGGTATAGGCAGGGAGATAGCATAGATGGCACTCCATATACCAATGCTGTAGG
ATTCATGCCCAATTTAAAAGCTTATCCAAAGTCACAAAGTTCTACTACTAAAAATAATATAGTAGGGCAAG
TATACATGAATGGAGATGTTTCAAAACCTATGCTTCTCACTATAACCCTCAATGGTACTGATGACAGCAACA
GTACATATTCAATGTCATTTTCATACACCTGGACTAATGGAAGCTATGTTGGAGCAACATTTGGGGCTAACT
CTTATACCTTCTCATACATCGCCCAAGAATGAACACTGTATCCCACCCTGCATGCCAACCCTTCCCACCCCA
CTCTGTGGAACAAACTCTGAAACACAAAATAAAATAAAGTTCAAGTGTTTTATTGATTCAACAGTTTTACA
GGATTCGAGCAGTTATTTTTCCTCCACCCTCCCAGGACATGGAATACACCACCCTCTCCCCCCGCACAGCCT
TGAACATCTGAATGCCATTGGTGATGGACATGCTTTTGGTCTCCACGTTCCACACAGTTTCAGAGCGAGCCA
GTCTCGGGTCGGTCAGGGAGATGAAACCCTCCGGGCACTCCCGCATCTGCACCTCACAGCTCAACAGCTGA
GGATTGTCCTCGGTGGTCGGGATCACGGTTATCTGGAAGAAGCAGAAGAGCGGCGGTGGGAATCATAGTCC
GCGAACGGGATCGGCCGGTGGTGTCGCATCAGGCCCCGCAGCAGTCGCTGCCGCCGCCGCTCCGTCAAGCT
GCTGCTCAGGGGGTCCGGGTCCAGGGACTCCCTCAGCATGATGCCCACGGCCCTCAGCATCAGTCGTCTGG
TGCGGCGGGCGCAGCAGCGCATGCGGATCTCGCTCAGGTCGCTGCAGTACGTGCAACACAGAACCACCAG
GTTGTTCAACAGTCCATAGTTCAACACGCTCCAGCCGAAACTCATCGCGGGAAGGATGCTACCCACGTGGC
CGTCGTACCAGATCCTCAGGTAAATCAAGTGGTGCCCCCTCCAGAACACGCTGCCCACGTACATGATCTCC
TTGGGCATGTGGCGGTTCACCACCTCCCGGTACCACATCACCCTCTGGTTGAACATGCAGCCCCGGATGATC
CTGCGGAACCACAGGGCCAGCACCGCCCCGCCCGCCATGCAGCGAAGAGACCCCGGGTCCCGGCAATGGC
AATGGAGGACCCACCGCTCGTACCCGTGGATCATCTGGGAGCTGAACAAGTCTATGTTGGCACAGCACAGG
CATATGCTCATGCATCTCTTCAGCACTCTCAACTCCTCGGGGGTCAAAACCATATCCCAGGGCACGGGGAA
CTCTTGCAGGACAGCGAACCCCGCAGAACAGGGCAATCCTCGCACAGAACTTACATTGTGCATGGACAGG
GTATCGCAATCAGGCAGCACCGGGTGATCCTCCACCAGAGAAGCGCGGGTCTCGGTCTCCTCACAGCGTGG
TAAGGGGGCCGGCCGATACGGGTGATGGCGGGACGCGGCTGATCGTGTTCGCGACCGTGTCATGATGCAGT
TGCTTTCGGACATTTTCGTACTTGCTGTAGCAGAACCTGGTCCGGGCGCTGCACACCGATCGCCGGCGGCG
GTCTCGGCGCTTGGAACGCTCGGTGTTGAAATTGTAAAACAGCCACTCTCTCAGACCGTGCAGCAGATCTA
GGGCCTCAGGAGTGATGAAGATCCCATCATGCCTGATGGCTCTGATCACATCGACCACCGTGGAATGGGCC
AGACCCAGCCAGATGATGCAATTTTGTTGGGTTTCGGTGACGGCGGGGAGGGAAGAACAGGAAGAACCA
TGATTAACTTTTAATCCAAACGGTCTCGGAGTACTTCAAAATGAAGATCGCGGAGATGGCACCTCTCGCCC
CCGCTGTGTTGGTGGAAAATAACAGCCAGGTCAAAGGTGATACGGTTCTCGAGATGTTCCACGGTGGCTTC
CAGCAAAGCCTCCACGCGCACATCCAGAAACAAGACAATAGCGAAAGCGGGAGGGTTCTCTAATTCCTCA
ATCATCATGTTACACTCCTGCACCATCCCCAGATAATTTTCATTTTTCCAGCCTTGAATGATTCGAACTAGTT
CCTGAGGTAAATCCAAGCCAGCCATGATAAAGAGCTCGCGCAGAGCGCCCTCCACCGGCATTCTTAAGCAC
ACCCTCATAATTCCAAGATATTCTGCTCCTGGTTCACCTGCAGCAGATTGACAAGCGGAATATCAAAATCTC
TGCCGCGATCCCTGAGCTCCTCCCTCAGCAATAACTGTAAGTACTCTTTCATATCCTCTCCGAAATTTTAGC
CATAGGACCACCAGGAATAAGATTAGGGCAAGCCACAGTACAGATAAACCGAAGTCCTCCCCAGTGAGCA
TTGCCAAATGCAAGACTGCTATAAGCATGCTGGCTAGACCCGGTGATATCTTCCAGATAACTGGACAGAAA
ATCGCCCAGGCAATTTTTAAGAAAATCAACAAAAGAAAAATCCTCCAGGTGGACGTTTAGAGCCTCGGGAA
CAACGATGAAGTAAATGCAAGCGGTGCGTTCCAGCATGGTTAGTTAGCTGATCTGTAGAAAAAACAAAAT
```

GAACATTAAACCATGCTAGCCTGGCGAACAGGTGGGTAAATCGTTCTCTCCAGCACCAGGCAGGCCACGGG

GTCTCCGGCGCGACCCTCGTAAAAATTGTCGCTATGATTGAAAACCATCACAGAGAGACGTTCCCGGTGGC

CGGCGTGAATGATTCGACAAGATGAATACACCCCCGGAACATTGGCGTCCGCGAGTGAAAAAAAGCGCCC

GAGGAAGCAATAAGGCACTACAATGCTCAGTCTCAAGTCCAGCAAAGCGATGCCATGCGGATGAAGCACA

AAATTCTCAGGTGCGTACAAAATGTAATTACTCCCCTCCTGCACAGGCAGCAAAGCCCCCGATCCCTCCAG

GTACACATACAAAGCCTCAGCGTCCATAGCTTACCGAGCAGCAGCACACAACAGGCGCAAGAGTCAGAGA

AAGGCTGAGCTCTAACCTGTCCACCCGCTCTCTGCTCAATATATAGCCCAGATCTACACTGACGTAAAGGC

CAAAGTCTAAAAATACCCGCCAAATAATCACACACGCCCAGCACACGCCCAGAAACCGGTGACACACTCA

AAAAAATACGCGCACTTCCTCAAACGCCCAAAACTGCCGTCATTTCCGGGTTCCCACGCTACGTCATCAAA

ACACGACTTTCAAATTCCGTCGACCGTTAAAAACGTCACCCGCCCCGCCCCTAACGGTCGCCCGTCTCTCAG

CCAATCAGCGCCCCGCATCCCCAAATTCAAACACCTCATTTGCATATTAACGCGCACAAAAAGTTTGAGGT

ATATTATTGATGATGG

ChAdV68-CMT-TSNA (SEQ ID NO: 68)
CATCATCAATAATATACCTCAAACTTTTTGTGCGCGTTAATATGCAAATGAGGCGTTTGAATTTGGGGAGGA

AGGGCGGTGATTGGTCGAGGGATGAGCGACCGTTAGGGGCGGGGCGAGTGACGTTTTGATGACGTGGTTG

CGAGGAGGAGCCAGTTTGCAAGTTCTCGTGGGAAAAGTGACGTCAAACGAGGTGTGGTTTGAACACGGAA

ATACTCAATTTTCCCGCGCTCTCTGACAGGAAATGAGGTGTTTCTGGGCGGATGCAAGTGAAAACGGGCCA

TTTTCGCGCGAAAACTGAATGAGGAAGTGAAAATCTGAGTAATTTCGCGTTTATGGCAGGGAGGAGTATTT

GCCGAGGGCCGAGTAGACTTTGACCGATTACGTGGGGGTTTCGATTACCGTGTTTTTCACCTAAATTTCCGC

GTACGGTGTCAAAGTCCGGTGTTTTTACGTAGGTGTCAGCTGATCGCCAGGGTATTTAAACCTGCGCTCTCC

AGTCAAGAGGCCACTCTTGAGTGCCAGCGAGAAGAGTTTTCTCCTCCGCGCCGCGAGTCAGATCTACACTT

TGAAAGTAGGGATAACAGGGTAATGACATTGATTATTGACTAGTTGTTAATAGTAATCAATTACGGGGTCA

TTAGTTCATAGCCCATATATGGAGTTCCGCGTTACATAACTTACGGTAAATGGCCCGCCTGGCTGACCGCCC

AACGACCCCCGCCCATTGACGTCAATAATGACGTATGTTCCCATAGTAACGCCAATAGGGACTTTCCATTG

ACGTCAATGGGTGGAGTATTTACGGTAAACTGCCCACTTGGCAGTACATCAAGTGTATCATATGCCAAGTC

CGCCCCCTATTGACGTCAATGACGGTAAATGGCCCGCCTGGCATTATGCCCAGTACATGACCTTACGGGAC

TTTCCTACTTGGCAGTACATCTACGTATTAGTCATCGCTATTACCATGGTGATGCGGTTTTGGCAGTACACC

AATGGGCGTGGATAGCGGTTTGACTCACGGGGATTTCCAAGTCTCCACCCCATTGACGTCAATGGGAGTTT

GTTTTGGCACCAAAATCAACGGGACTTTCCAAAATGTCGTAATAACCCCGCCCCGTTGACGCAAATGGGCG

GTAGGCGTGTACGGTGGGAGGTCTATATAAGCAGAGCTCTCCCTATCAGTGATAGAGATCTCCCTATCAGT

GATAGAGATCGTCGACGAGCTCGTTTAGTGAACCGTCAGATCGCCTGGAACGCCATCCACGCTGTTTTGAC

CTCCATAGAAGACAGCGATCGCGCCACCATGGCTGGCATGACCGAGTACAAGCTAGTCGTTGTGGGAGCTG

GAGATGTGGGCAAATCTGCTCTGACCATTCAGCTGATTCAGGGCACAGATCTGGATCACCAGGAGAAGTGT

CTGAGCAGGCTGTACGACCACATGCCAGAAGGATTAACCCCTCTTATGGGAGTGAGCTCTTCTTCTGCTCTG

GCCAGACTGGGACTGCCTATGGATAAGCTGAACAAGATCACAGCTCCTGCCTCTCAGAAACTGAGACAGT

GCAGAAGATGGAGACCCCTGAACTGCTGCCTTGTGGATATCGGTGGAGGAGAATACCACAATCAGCGTGA

CCGTGAAAGGCCTGGAAGCCCAGAACAAGATCAAAGGCTGTACCGGCTCTGTGAATATGACACTGCAGAG

AGCTTCTGCCGCCCCTAAGACAGGAGGAGGAGGAGAAGCTGCTGCCTACAATAATACATTAGTGGCCAGA

CATGTGCCCCAGATCCCTAAGCCTGACAGCCTGGTTGGCCTGAGCGATGAATTAGGAAAAAGAGACACATT

TGCCGAGAGCCTGATCGGAGAATGGCCTCTGCCGGCTACCTGTTCCTGGATATCATCACATATGTTGTGTT

TGCCGTGACCTTCGTGCTGGGAGTTCTGGGCGGCCTGAATACCGAGACCAATGAAAAAGCTCTTGAAGCCG

-continued

```
TGTTTGGCAAGTACGGCAGAATCGTGGAGGTGCTGGGCGGCAGATCTTGTGAAGAATTAACAGCTGTGTTA

CCACCTCCTCAGCTGCTTGGCAGACGGTTCAACTTCTTCAGCTACAGCTACGTTGCTGCTGGCTCTTCTGGC

AACAACTACGACCTGATGGCCCAGCCTATTACACCTGGACCTGATACAACACCTCTGCCTGTGACCGATAC

ATCTTCTGTGTCTACCGGACACGCCACATCTCTGCCAGTGACAGATGCTGGACTGAGAGTGACAGAGTCTA

AAGGACACAGCGATTCTTGGCACCTGAGCCTGGATACAGCCATCAGGGTGAATACCCCTAAGCTGGTTTCT

GAAGTGGAAGAGCTGAACAAGAGCATCACCGCCCTGAGGGAGAAGTTACTGCAGATGGTGGAAGCCGATA

GACCTGGAAACCTGTTTATTGGAGGCCTGAACACCGAGACCAATGAGGACTCTCCCGTGAAGGATGAAGTG

GTGGTGAACGATCAATGGGGCCAGAATTGTAGCTGCCATCATGGAGGCTACGAGTTCCCTGATCTGCACAG

GACAATCGTGTCTGAGTGCGATGTGTATCTGACCTACATGCTGAGACAGGCTGCTCTGCAGCTGTTCTTCGA

CCTGTATCACAGCATCCCTAGCAGCTTTTCTCCTCTGGTTCTGAGCTGTCTGGTGCAGCCTCTGGAAGATGT

GGAAGTGATGGAGAAGGATGGCACAACCTTTAGCTGTGAGGTGAGCCACGATGAGGTGCCTCGGACATAT

GGACCCGTGTTTATGTGTCTGGGAGGACTGCTGACCATGGTGGCTGGAGCTGTTTGGCTGACAGTTGGACC

CGGACCAGGCGCCAAATTTGTTGCTGCTTGGACACTGAAAGCTGCTGCTGGGCCCGGACCAGGCCAGTACA

TCAAGGCCAACTCTAAGTTTATCGGCATCACCGAATTGGGACCTGGACCCGGCTAGTAGTGAGTTTAAACT

CCCATTTAAATGTGAGGGTTAATGCTTCGAGCAGACATGATAAGATACATTGATGAGTTTGGACAAACCAC

AACTAGAATGCAGTGAAAAAAATGCTTTATTTGTGAAATTTGTGATGCTATTGCTTTATTTGTAACCATTAT

AAGCTGCAATAAACAAGTTAACAACAACAATTGCATTCATTTTATGTTTCAGGTTCAGGGGGAGATGTGGG

AGGTTTTTAAAGCAAGTAAAACCTCTACAAATGTGGTAAAATAACTATAACGGTCCTAAGGTAGCGAGTG

AGTAGTGTTCTGGGGCGGGGAGGACCTGCATGAGGGCCAGAATAACTGAAATCTGTGCTTTTCTGTGTGT

TGCAGCAGCATGAGCGGAAGCGGCTCCTTTGAGGGAGGGGTATTCAGCCCTTATCTGACGGGGCGTCTCCC

CTCCTGGGCGGGAGTGCGTCAGAATGTGATGGGATCCACGGTGGACGGCCGGCCCGTGCAGCCCGCGAAC

TCTTCAACCCTGACCTATGCAACCCTGAGCTCTTCGTCGTTGGACGCAGCTGCCGCCGCAGCTGCTGCATCT

GCCGCCAGCGCCGTGCGCGGAATGGCCATGGGCGCCGGCTACTACGGCACTCTGGTGGCCAACTCGAGTTC

CACCAATAATCCCGCCAGCCTGAACGAGGAGAAGCTGTTGCTGCTGATGGCCCAGCTCGAGGCCTTGACCC

AGCGCCTGGGCGAGCTGACCCAGCAGGTGGCTCAGCTGCAGGAGCAGACGCGGGCCGCGGTTGCCACGGT

GAAATCCAAATAAAAAATGAATCAATAAATAAACGGAGACGGTTGTTGATTTTAACACAGAGTCTGAATCT

TTATTTGATTTTTCGCGCGCGGTAGGCCCTGGACCACCGGTCTCGATCATTGAGCACCCGGTGGATCTTTTC

CAGGACCCGGTAGAGGTGGGCTTGGATGTTGAGGTACATGGGCATGAGCCCGTCCCGGGGGTGGAGGTAG

CTCCATTGCAGGGCCTCGTGCTCGGGTGGTGTTGTAAATCACCCCAGTCATAGCAGGGGCGCAGGGCATG

GTGTTGCACAATATCTTTGAGGAGGAGACTGATGGCCACGGGCAGCCCTTTGGTGTAGGTGTTTACAAATC

TGTTGAGCTGGGAGGGATGCATGCGGGGGAGATGAGGTGCATCTTGGCCTGGATCTTGAGATTGGCGATG

TTACCGCCCAGATCCCGCCTGGGGTTCATGTTGTGCAGGACCACCAGCACGGTGTATCCGGTGCACTTGGG

GAATTTATCATGCAACTTGGAAGGGAAGGCGTGAAAGAATTTGGCGACGCCTTTGTGCCCGCCCAGGTTTT

CCATGCACTCATCCATGATGATGGCGATGGGCCCGTGGGCGGCGGCCTGGGCAAAGACGTTTCGGGGGTCG

GACACATCATAGTTGTGGTCCTGGGTGAGGTCATCATAGGCCATTTTAATGAATTTGGGGCGGAGGGTGCC

GGACTGGGGGACAAAGGTTCCCTCGATCCCGGGGCGTAGTTCCCCTCACAGATCTGCATCTCCCAGGCTT

TGAGCTCGGAGGGGGGATCATGTCCACCTGCGGGCGATAAAGAACACGGTTTCCGGGGCGGGGAGAT

GAGCTGGGCCGAAAGCAAGTTCCGGAGCAGCTGGGACTTGCCGCAGCCGGTGGGGCCGTAGATGACCCCG

ATGACCGGCTGCAGGTGGTAGTTGAGGGAGAGACAGCTGCCGTCCTCCCGGAGGAGGGGGCCACCTCGT

TCATCATCTCGCGCACGTGCATGTCTCGCGCACCAGTTCCGCCAGGAGGCGCTCTCCCCCCAGGGATAGG
```

-continued

```
AGCTCCTGGAGCGAGGCGAAGTTTTTCAGCGGCTTGAGTCCGTCGGCCATGGGCATTTTGGAGAGGGTTTG

TTGCAAGAGTTCCAGGCGGTCCCAGAGCTCGGTGATGTGCTCTACGGCATCTCGATCCAGCAGACCTCCTC

GTTTCGCGGGTTGGGACGGCTGCGGGAGTAGGGCACCAGACGATGGGCGTCCAGCGCAGCCAGGGTCCGG

TCCTTCCAGGGTCGCAGCGTCCGCGTCAGGGTGGTCTCCGTCACGGTGAAGGGGTGCGCGCCGGGCTGGGC

GCTTGCGAGGGTGCGCTTCAGGCTCATCCGGCTGGTCGAAAACCGCTCCCGATCGGCGCCCTGCGCGTCGG

CCAGGTAGCAATTGACCATGAGTTCGTAGTTGAGCGCCTCGGCCGCGTGGCCTTTGGCGCGGAGCTTACCTT

TGGAAGTCTGCCCGCAGGCGGGACAGAGGAGGGACTTGAGGGCGTAGAGCTTGGGGGCGAGGAAGACGG

ACTCGGGGCGTAGGCGTCCGCGCCGCAGTGGGCGCAGACGGTCTCGCACTCCACGAGCCAGGTGAGGTC

GGGCTGGTCGGGGTCAAAAACCAGTTTCCCGCCGTTCTTTTTGATGCGTTTCTTACCTTTGGTCTCCATGAGC

TCGTGTCCCCGCTGGGTGACAAAGAGGCTGTCCGTGTCCCCGTAGACCGACTTTATGGGCCGGTCCTCGAG

CGGTGTGCCGCGGTCCTCCTCGTAGAGGAACCCCGCCCACTCCGAGACGAAAGCCCGGGTCCAGGCCAGCA

CGAAGGAGGCCACGTGGGACGGGTAGCGGTCGTTGTCCACCAGCGGGTCCACCTTTTCCAGGGTATGCAAA

CACATGTCCCCCTCGTCCACATCCAGGAAGGTGATTGGCTTGTAAGTGTAGGCCACGTGACCGGGGTCCC

GGCCGGGGGGTATAAAAGGGTGCGGGTCCCTGCTCGTCCTCACTGTCTTCCGGATCGCTGTCCAGGAGCG

CCAGCTGTTGGGGTAGGTATTCCCTCTCGAAGGCGGGCATGACCTCGGCACTCAGGTTGTCAGTTTCTAGAA

ACGAGGAGGATTTGATATTGACGGTGCCGGCGGAGATGCCTTTCAAGAGCCCCTCGTCCATCTGGTCAGAA

AAGACGATCTTTTTGTTGTCGAGCTTGGTGGCGAAGGAGCCGTAGAGGGCGTTGGAGAGGAGCTTGGCGAT

GGAGCGCATGGTCTGGTTTTTTTCCTTGTCGGCGCGCTCCTTGGCGGCGATGTTGAGCTGCACGTACTCGCG

CGCCACGCACTTCCATTCGGGGAAGACGGTGGTCAGCTCGTCGGGCACGATTCTGACCTGCCAGCCCCGAT

TATGCAGGGTGATGAGGTCCACACTGGTGGCCACCTCGCCGCGCAGGGGCTCATTAGTCCAGCAGAGGCGT

CCGCCCTTGCGCGAGCAGAAGGGGGGCAGGGGGTCCAGCATGACCTCGTCGGGGGGGTCGGCATCGATGG

TGAAGATGCCGGGCAGGAGGTCGGGGTCAAAGTAGCTGATGGAAGTGGCCAGATCGTCCAGGGCAGCTTG

CCATTCGCGCACGGCCAGCGCGCGCTCGTAGGGACTGAGGGGCGTGCCCCAGGGCATGGGATGGGTAAGC

GCGGAGGCGTACATGCCGCAGATGTCGTAGACGTAGAGGGGCTCCTCGAGGATGCCGATGTAGGTGGGGT

AGCAGCGCCCCCCGCGGATGCTGGCGCGCACGTAGTCATACAGCTCGTGCGAGGGGGCGAGGAGCCCCGG

GCCCAGGTTGGTGCGACTGGGCTTTTCGGCGCGGTAGACGATCTGGCGGAAAATGGCATGCGAGTTGGAGG

AGATGGTGGGCCTTTGGAAGATGTTGAAGTGGGCGTGGGCAGTCCGACCGAGTCGCGGATGAAGTGGGC

GTAGGAGTCTTGCAGCTTGGCGACGAGCTCGGCGGTGACTAGGACGTCCAGAGCGCAGTAGTCGAGGGTCT

CCTGGATGATGTCATACTTGAGCTGTCCCTTTTGTTTCCACAGCTCGCGGTTGAGAAGGAACTCTTCGCGGT

CCTTCCAGTACTCTTCGAGGGGGAACCCGTCCTGATCTGCACGGTAAGAGCCTAGCATGTAGAACTGGTTG

ACGGCCTTGTAGGCGCAGCAGCCCTTCTCCACGGGGAGGGCGTAGGCCTGGGCGGCCTTGCGCAGGGAGG

TGTGCGTGAGGGCGAAAGTGTCCCTGACCATGACCTTGAGGAACTGGTGCTTGAAGTCGATATCGTCGCAG

CCCCCCTGCTCCCAGAGCTGGAAGTCCGTGCGCTTCTTGTAGGCGGGGTTGGGCAAAGCGAAGTAACATC

GTTGAAGAGGATCTTGCCCGCGCGGGGCATAAAGTTGCGAGTGATTGCGGAAAGGTTGGGGCACCTCGGCC

CGGTTGTTGATGACCTGGGCGGCGAGCACGATCTCGTCGAAGCCGTTGATGTTGTGGCCCACGATGTAGAG

TTCCACGAATCGCGGACGGCCCTTGACGTGGGCAGTTTCTTGAGCTCCTCGTAGGTGAGCTCGTCGGGGTC

GCTGAGCCCGTGCTGCTCGAGCGCCCAGTCGGCGAGATGGGGGTTGGCGCGGAGGAAGGAAGTCCAGAGA

TCCACGCCAGGGCGGTTTGCAGACGGTCCCGGTACTGACGGAACTGCTGCCCGACGGCCATTTTTTCGGG

GGTGACGCAGTAGAAGGTGCGGGGGTCCCCGTGCCAGCGATCCCATTTGAGCTGGAGGGCGAGATCGAGG

GCGAGCTCGACGAGCCGGTCGTCCCCGGAGAGTTTCATGACCAGCATGAAGGGGACGAGCTGCTTGCCGA

AGGACCCCATCCAGGTGTAGGTTTCCACATCGTAGGTGAGGAAGAGCCTTTCGGTGCGAGGATGCGAGCCG
```

```
ATGGGGAAGAACTGGATCTCCTGCCACCAATTGGAGGAATGGCTGTTGATGTGATGGAAGTAGAAATGCCG

ACGGCGCGCCGAACACTCGTGCTTGTGTTTATACAAGCGGCCACAGTGCTCGCAACGCTGCACGGGATGCA

CGTGCTGCACGAGCTGTACCTGAGTTCCTTTGACGAGGAATTTCAGTGGGAAGTGGAGTCGTGGCGCCTGC

ATCTCGTGCTGTACTACGTCGTGGTGGTCGGCCTGGCCCTCTTCTGCCTCGATGGTGGTCATGCTGACGAGC

CCGCGCGGGAGGCAGGTCCAGACCTCGGCGCGAGCGGGTCGGAGAGCGAGGACGAGGGCGCGCAGGCCG

GAGCTGTCCAGGGTCCTGAGACGCTGCGGAGTCAGGTCAGTGGGCAGCGGCGGCGCGCGGTTGACTTGCA

GGAGTTTTTCCAGGGCGCGCGGGAGGTCCAGATGGTACTTGATCTCCACCGCGCCATTGGTGGCGACGTCG

ATGGCTTGCAGGGTCCCGTGCCCCTGGGGTGTGACCACCGTCCCCCGTTTCTTCTTGGGCGGCTGGGGCGAC

GGGGGCGGTGCCTCTTCCATGGTTAGAAGCGGCGGCGAGGACGCGCGCCGGGCGGCAGGGGCGGCTCGGG

GCCCGGAGGCAGGGGCGGCAGGGGCACGTCGGCGCCGCGCGGGTAGGTTCTGGTACTGCGCCCGGAGA

AGACTGGCGTGAGCGACGACGCGACGGTTGACGTCCTGGATCTGACGCCTCTGGGTGAAGGCCACGGGAC

CCGTGAGTTTGAACCTGAAAGAGAGTTCGACAGAATCAATCTCGGTATCGTTGACGGCGGCCTGCCGCAGG

ATCTCTTGCACGTCGCCCGAGTTGTCCTGGTAGGCGATCTCGGTCATGAACTGCTCGATCTCCTCCTCTTGA

AGGTCTCCGCGGCCGGCGCGCTCCACGGTGGCCGCGAGGTCGTTGGAGATGCGGCCCATGAGCTGCGAGA

AGGCGTTCATGCCCGCCTCGTTCCAGACGCGGCTGTAGACCACGACGCCCTCGGGATCGCGGGCGCGCATG

ACCACCTGGGCGAGGTTGAGCTCCACGTGGCGCGTGAAGACCGCGTAGTTGCAGAGGCGCTGGTAGAGGT

AGTTGAGCGTGGTGGCGATGTGCTCGGTGACGAAGAAATACATGATCCAGCGGCGGAGCGGCATCTCGCTG

ACGTCGCCCAGCGCCTCCAAACGTTCCATGGCCTCGTAAAAGTCCACGGCGAAGTTGAAAAACTGGGAGTT

GCGCGCCGAGACGGTCAACTCCTCCTCCAGAAGACGGATGAGCTCGGCGATGGTGGCGCGCACCTCGCGCT

CGAAGGCCCCCGGGAGTTCCTCCACTTCCTCTTCTTCCTCCTCCACTAACATCTCTTCTACTTCCTCCTCAGG

CGGCAGTGGTGGCGGGGAGGGGGCCTGCGTCGCCGGCGGCGCACGGCAGACGGTCGATGAAGCGCTCG

ATGGTCTCGCCGCGCCGGCGTCGCATGGTCTCGGTGACGGCGCGCCCGTCCTCGCGGGGCCGCAGCGTGAA

GACGCCGCCGCGCATCTCCAGGTGGCCGGGGGGTCCCCGTTGGGCAGGGAGAGGGCGCTGACGATGCAT

CTTATCAATTGCCCCGTAGGGACTCCGCGCAAGGACCTGAGCGTCTCGAGATCCACGGGATCTGAAAACCG

CTGAACGAAGGCTTCGAGCCAGTCGCAGTCGCAAGGTAGGCTGAGCACGGTTTCTTCTGGCGGGTCATGTT

GGTTGGGAGCGGGGCGGGCGATGCTGCTGGTGATGAAGTTGAAATAGGCGGTTCTGAGACGGCGGATGGT

GGCGAGGAGCACCAGGTCTTTGGGCCCGGCTTGCTGGATGCGCAGACGGTCGGCCATGCCCCAGGCGTGGT

CCTGACACCTGGCCAGGTCCTTGTAGTAGTCCTGCATGAGCCGCTCCACGGGCACCTCCTCCTCGCCCGCGC

GGCCGTGCATGCGCGTGAGCCCGAAGCCGCGCTGGGGCTGGACGAGCGCCAGGTCGGCGACGACGCGCTC

GGCGAGGATGGCTTGCTGGATCTGGGTGAGGGTGGTCTGGAAGTCATCAAAGTCGACGAAGCGGTGGTAG

GCTCCGGTGTTGATGGTGTAGGAGCAGTTGGCCATGACGGACCAGTTGACGGTCTGGTGCCCGGACGCAC

GAGCTCGTGGTACTTGAGGCGCGAGTAGGCGCGCGTGTCGAAGATGTAGTCGTTGCAGGTGCGCACCAGGT

ACTGGTAGCCGATGAGGAAGTGCGGCGGCGGCTGGCGGTAGAGCGGCCATCGCTCGGTGGCGGGGCGCC

GGGCGCGAGGTCCTCGAGCATGGTGCGGTGGTAGCCGTAGATGTACCTGGACATCCAGGTGATGCCGGCGG

CGGTGGTGGAGGCGCGCGGGAACTCGCGGACGCGGTTCCAGATGTTGCGCAGCGGCAGGAAGTAGTTCAT

GGTGGGCACGGTCTGGCCCGTGAGGCGCGCAGTCGTGGATGCTCTATACGGGCAAAAACGAAAGCGGT

CAGCGGCTCGACTCGTGGCCTGGAGGCTAAGCGAACGGGTTGGGCTGCGCGTGTACCCCGGTTCGAATCT

CGAATCAGGCTGGAGCCGCAGCTAACGTGGTATTGGCACTCCCGTCTCGACCCAAGCCTGCACCAACCCTC

CAGGATACGGAGGCGGGTCGTTTTGCAACTTTTTTTTGGAGGCCGGATGAGACTAGTAAGCGCGGAAAGCG

GCCGACCGCGATGGCTCGCTGCCGTAGTCTGGAGAAGAATCGCCAGGGTTGCGTTGCGGTGTGCCCCGGTT
```

-continued

```
CGAGGCCGGCCGGATTCCGCGGCTAACGAGGGCGTGGCTGCCCCGTCGTTTCCAAGACCCCATAGCCAGCC
GACTTCTCCAGTTACGGAGCGAGCCCCTCTTTTGTTTTGTTTGTTTTTGCCAGATGCATCCCGTACTGCGGCA
GATGCGCCCCCACCACCCTCCACCGCAACAACAGCCCCCTCCACAGCCGGCGCTTCTGCCCCCGCCCCAGC
AGCAACTTCCAGCCACGACCGCCGCGCCGCCGTGAGCGGGGCTGGACAGAGTTATGATCACCAGCTGGC
CTTGGAAGAGGGCGAGGGGCTGGCGCGCCTGGGGCGTCGTCGCCGGAGCGGCACCCGCGCGTGCAGATG
AAAAGGGACGCTCGCGAGGCCTACGTGCCCAAGCAGAACCTGTTCAGAGACAGGAGCGGCGAGGAGCCCG
AGGAGATGCGCGCGGCCCGGTTCCACGCGGGGCGGGAGCTGCGGCGCGGCCTGGACCGAAAGAGGGTGCT
GAGGGACGAGGATTTCGAGGCGGACGAGCTGACGGGGATCAGCCCCGCGCGCGCACGTGGCCGCGGCC
AACCTGGTCACGGCGTACGAGCAGACCGTGAAGGAGGAGAGCAACTTCCAAAAATCCTTCAACAACCACG
TGCGCACCCTGATCGCGCGCGAGGAGGTGACCCTGGGCCTGATGCACCTGTGGGACCTGCTGGAGGCCATC
GTGCAGAACCCCACCAGCAAGCCGCTGACGGCGCAGCTGTTCCTGGTGGTGCAGCATAGTCGGGACAACG
AAGCGTTCAGGGAGGCGCTGCTGAATATCACCGAGCCCGAGGGCCGCTGGCTCCTGGACCTGGTGAACATT
CTGCAGAGCATCGTGGTGCAGGAGCGCGGGCTGCCGCTGTCCGAGAAGCTGGCGGCCATCAACTTCTCGGT
GCTGAGTTTGGGCAAGTACTACGCTAGGAAGATCTACAAGACCCCGTACGTGCCCATAGACAAGGAGGTG
AAGATCGACGGGTTTTACATGCGCATGACCCTGAAAGTGCTGACCCTGAGCGACGATCTGGGGGTGTACCG
CAACGACAGGATGCACCGTGCGGTGAGCGCCAGCAGGCGGCGCGAGCTGAGCGACCAGGAGCTGATGCAT
AGTCTGCAGCGGGCCCTGACCGGGGCCGGGACCGAGGGGGAGAGCTACTTTGACATGGGCGCGGACCTGC
ACTGGCAGCCCAGCCGCCGGGCCTTGGAGGCGGCGGCAGGACCCTACGTAGAAGAGGTGGACGATGAGGT
GGACGAGGAGGGCGAGTACCTGGAAGACTGATGGCGCGACCGTATTTTTGCTAGATGCAACAACAACAGC
CACCTCCTGATCCCGCGATGCGGGCGGCGCTGCAGAGCCAGCCGTCCGGCATTAACTCCTCGGACGATTGG
ACCCAGGCCATGCAACGCATCATGGCGCTGACGACCCGCAACCCCGAAGCCTTTAGACAGCAGCCCCAGG
CCAACCGGCTCTCGGCCATCCTGGAGGCCGTGGTGCCCTCGCGCTCCAACCCCACGCACGAGAAGGTCCTG
GCCATCGTGAACGCGCTGGTGGAGAACAAGGCCATCCGCGGCGACGAGGCCGGCCTGGTGTACAACGCGC
TGCTGGAGCGCGTGGCCCGCTACAACAGCACCAACGTGCAGACCAACCTGGACCGCATGGTGACCGACGT
GCGCGAGGCCGTGGCCCAGCGCGAGCGGTTCCACCGCGAGTCCAACCTGGGATCCATGGTGGCGCTGAAC
GCCTTCCTCAGCACCCAGCCCGCCAACGTGCCCCGGGGCCAGGAGGACTACACCAACTTCATCAGCGCCCT
GCGCCTGATGGTGACCGAGGTGCCCCAGAGCGAGGTGTACCAGTCCGGGCCGGACTACTTCTTCCAGACCA
GTCGCCAGGGCATTGCAGACCGTGAACCTGAGCCAGGCTTTCAAGAACTTGCAGGGCCTGTGGGGCGTGCAG
GCCCCGGTCGGGACCGCGCGACGGTGTCGAGCCTGCTGACGCCGAACTCGCGCCTGCTGCTGCTGCTGGT
GGCCCCCTTCACGGACAGCGGCAGCATCAACCGCAACTCGTACCTGGGCTACCTGATTAACCTGTACCGCG
AGGCCATCGGCCAGGCGCACGTGGACGAGCAGACCTACCAGGAGATCACCCACGTGAGCCGCGCCCTGGG
CCAGGACGACCCGGGCAACCTGGAAGCCACCCTGAACTTTTTGCTGACCAACCGGTCGCAGAAGATCCCGC
CCCAGTACGCGCTCAGCACCGAGGAGGAGCGCATCCTGCGTTACGTGCAGCAGAGCGTGGGCCTGTTCCTG
ATGCAGGAGGGGCCACCCCCAGCGCCGCGCTCGACATGACCGCGCGCAACATGGAGCCCAGCATGTACG
CCAGCAACCGCCCGTTCATCAATAAACTGATGGACTACTTGCATCGGGCGGCCGCCATGAACTCTGACTAT
TTCACCAACGCCATCCTGAATCCCCACTGGCTCCCGCCGCCGGGGTTCTACACGGGCGAGTACGACATGCC
CGACCCCAATGACGGGTTCCTGTGGGACGATGTGGACAGCAGCGTGTTCTCCCCCCGACCGGGTGCTAACG
AGCGCCCCTTGTGGAAGAAGGAAGGCAGCGACCGACGCCCGTCCTCGGCGCTGTCCGGCCGCGAGGGTGC
TGCCGCGGCGGTGCCCGAGGCCGCCAGTCCTTTCCCGAGCTTGCCCTTCTCGCTGAACAGTATCCGCAGCA
GCGAGCTGGCAGGATCACGCGCCCGCGCTTGCTGGGCGAAGAGGAGTACTTGAATGACTCGCTGTTGAGA
CCCGAGCGGGAGAAGAACTTCCCCAATAACGGGATAGAAAGCCTGGTGGACAAGATGAGCCGCTGGAAGA
```

-continued

```
CGTATGCGCAGGAOCACAGGGACGATCCCCGGGCGTCGCAGGGGGCCACGAGCCGGGGCAGCGCCGCCCG

TAAACGCCGGTGGCACGACAGGCAGCGGGGACAGATGTGGGACGATGAGGACTCCGCCGACGACAGCAGC

GTGTTGGACTTGGGTGGGAGTGGTAACCCGTTCGCTCACCTGCGCCCCCGTATCGGGCGCATGATGTAAGA

GAAACCGAAATAAATGATACTCACCAAGGCCATGGCGACCAGCGTGCGTTCGTTTCTTCTCTGTTGTTGTT

GTATCTAGTATGATGAGGCGTGCGTACCCGGAGGGTCCTCCTCCCTCGTACGAGAGCGTGATGCAGCAGGC

GATGGCGGCGGCGGCGATGCAGCCCCCGCTGGAGGCTCCTTACGTGCCCCCGCGGTACCTGGCGCCTACGG

AGGGGCGGAACAGCATTCGTTACTCGGAGCTGGCACCCTTGTACGATACCACCCGGTTGTACCTGGTGGAC

AACAAGTCGGCGGACATCGCCTCGCTGAACTACCAGAACGACCACAGCAACTTCCTGACCACCGTGGTGCA

GAACAATGACTTCACCCCCACGGAGGCCAGCACCCAGACCATCAACTTTGACGAGCGCTCGCGGTGGGGC

GGCCAGCTGAAAACCATCATGCACACCAACATGCCCAACGTGAACGAGTTCATGTACAGCAACAAGTTCA

AGGCGCGGGTGATGGTCTCCCGCAAGACCCCCAATGGGGTGACAGTGACAGAGGATTATGATGGTAGTCA

GGATGAGCTGAAGTATGAATGGGTGGAATTTGAGCTGCCCGAAGGCAACTTCTCGGTGACCATGACCATCG

ACCTGATGAACAACGCCATCATCGACAATTACTTGGCGGTGGGGCGGCAGAACGGGGTGCTGGAGAGCGA

CATCGGCGTGAAGTTCGACACTAGGAACTTCAGGCTGGCTGGGACCCCGTGACCGAGCTGGTCATGCCCG

GGGTGTACACCAACGAGGCTTTCCATCCCGATATTGTCTTGCTGCCCGGCTGCGGGGTGGACTTCACCGAG

AGCCGCCTCAGCAACCTGCTGGGCATTCGCAAGAGGCAGCCCTTCCAGGAAGGCTTCCAGATCATGTACGA

GGATCTGGAGGGGGGCAACATCCCCGCGCTCCTGGATGTCGACGCCTATGAGAAAAGCAAGGAGGATGCA

GCAGCTGAAGCAACTGCAGCCGTAGCTACCGCCTCTACCGAGGTCAGGGGCGATAATTTTGCAAGCGCCGC

AGCAGTGGCAGCGGCCGAGGCGGCTGAAACCGAAAGTAAGATAGTCATTCAGCCGGTGGAGAAGGATAGC

AAGAACAGGAGCTACAACGTACTACCGGACAAGATAAACACCGCCTACCGCAGCTGGTACCTAGCCTACA

ACTATGGCGACCCCGAGAAGGGCGTGCGCTCCTGGACGCTGCTCACCACCTCGGACGTCACCTGCGGCGTG

GAGCAAGTCTACTGGTCGCTGCCCGACATGATGCAAGACCCGGTCACCTTCCGCTCCACGCGTCAAGTTAG

CAACTACCCGGTGGTGGGCGCCGAGCTCCTGCCCGTCTACTCCAAGAGCTTCTTCAACGAGCAGGCCGTCT

ACTCGCAGCAGCTGCGCGCCTTCACCTCGCTTACGCACGTCTTCAACCGCTTCCCCGAGAACCAGATCCTCG

TCCGCCCGCCCGCGCCCACCATTACCACCGTCAGTGAAAACGTTCCTGCTCTCACAGATCACGGGACCCTG

CCGCTGCGCAGCAGTATCCGGGGAGTCCAGCGCGTGACCGTTACTGACGCCAGACGCCGCACCTGCCCCTA

CGTCTACAAGGCCCTGGGCATAGTCGCGCCGCGCGTCCTCTCGAGCCGCACCTTCTAAATGTCCATTCTCAT

CTCGCCCAGTAATAACACCGGTTGGGGCCTGCGCGCGCCCAGCAAGATGTACGGAGGCGCTCGCCAACGCT

CCACGCAACACCCCGTGCGCGTGCGCGGGCACTTCCGCGCTCCCTGGGGCGCCCTCAAGGGCCGCGTGCGG

TCGCGCACCACCGTCGACGACGTGATCGACCAGGTGGTGGCCGACGCGCGCAACTACACCCCCGCCGCCGC

GCCCGTCTCCACCGTGGACGCCGTCATCGACAGCGTGGTGGCCGACGCGCGCCGGTACGCCCGCGCCAAGA

GCCGGCGGCGGCGCATCGCCCGGCGGCACCGGAGCACCCCCGCCATGCGCGCGGCGCGAGCCTTGCTGCG

CAGGGCCAGGCGCACGGGACGCAGGGCCATGCTCAGGGCGGCCAGAGCGCGCGGCTTCAGGCGCCAGCGCC

GGCAGGACCCGGAGACGCGCGGCCACGGCGGCGGCAGCGGCCATCGCCAGCATGTCCCGCCCGCGGCGAG

GGAACGTGTACTGGGTGCGCGACGCCGCCACCGGTGTGCGCGTGCCCGTGCGCACCCGCCCCCCTCGCACT

TGAAGATGTTCACTTCGCGATGTTGATGTGTCCCAGCGGCGAGGAGGATGTCCAAGCGCAAATTCAAGGAA

GAGATGCTCCAGGTCATCGCGCCTGAGATCTACGGCCCTGCGGTGGTGAAGGAGGAAAGAAAGCCCCGCA

AAATCAAGCGGGTCAAAAAGGACAAAAAGGAAGAAGAAAGTGATGTGGACGGATTGGTGGAGTTTGTGCG

CGAGTTCGCCCCCCGGCGGCGCGTGCAGTGGCGCGGGCGGAAGGTGCAACCGGTGCTGAGACCCGGCACC

ACCGTGGTCTTCACGCCCGGCGAGCGCTCCGGCACCGCTTCCAAGCGCTCCTACGACGAGGTGTACGGGA
```

-continued

```
TGATGATATTCTGGAGCAGGCGGCCGAGCGCCTGGGCGAGTTTGCTTACGGCAAGCGCAGCCGTTCCGCAC

CGAAGGAAGAGGCGGTGTCCATCCCGCTGGACCACGGCAACCCCACGCCGAGCCTCAAGCCCGTGACCTT

GCAGCAGGTGCTGCCGACCGCGGCGCCGCGCCGGGGGTTCAAGCGCGAGGGCGAGGATCTGTACCCCACC

ATGCAGCTGATGGTGCCCAAGCGCCAGAAGCTGGAAGACGTGCTGGAGACCATGAAGGTGGACCCGGACG

TGCAGCCCGAGGTCAAGGTGCGGCCCATCAAGCAGGTGGCCCCGGGCCTGGGCGTGCAGACCGTGGACAT

CAAGATTCCCACGGAGCCCATGGAAACGCAGACCGAGCCCATGATCAAGCCCAGCACCAGCACCATGGAG

GTGCAGACGGATCCCTGGATGCCATCGGCTCCTAGTCGAAGACCCCGGCGCAAGTACGGCGCGGCCAGCCT

GCTGATGCCCAACTACGCGCTGCATCCTTCCATCATCCCCACGCCGGGCTACCGCGGCACGCGCTTCTACCG

CGGTCATACCAGCAGCCGCCGCCGCAAGACCACCACTCGCCGCCGCCGTCGCCGCACCGCCGCTGCAACCA

CCCCTGCCGCCCTGGTGCGGAGAGTGTACCGCCGCGGCCGCGCACCTCTGACCCTGCCGCGCGCGCGCTAC

CACCCGAGCATCGCCATTTAAACTTTCGCCTGCTTTGCAGATCAATGGCCCTCACATGCCGCCTTCGCGTTC

CCATTACGGGCTACCGAGGAAGAAAACCGCGCCGTAGAAGGCTGGCGGGGAACGGGATGCGTCGCCACCA

CCACCGGCGGCGGCGCGCCATCAGCAAGCGGTTGGGGGGAGGCTTCCTGCCCGCGCTGATCCCCATCATCG

CCGCGGCGATCGGGGCGATCCCCGGCATTGCTTCCGTGGCGGTGCAGGCCTCTCAGCGCCACTGAGACACA

CTTGGAAACATCTTGTAATAAACCAATGGACTCTGACGCTCCTGGTCCTGTGATGTGTTTTCGTAGACAGAT

GGAAGACATCAATTTTTCGTCCCTGGCTCCGCGACACGGCACGCGGCCGTTCATGGGCACCTGGAGCGACA

TCGGCACCAGCCAACTGAACGGGGGCGCCTTCAATTGGAGCAGTCTCTGGAGCGGGCTTAAGAATTTCGGG

TCCACGCTTAAAACCTATGGCAGCAAGGCGTGGAACAGCACCACAGGGCAGGCGCTGAGGGATAAGCTGA

AAGAGCAGAACTTCCAGCAGAAGGTGGTCGATGGGCTCGCCTCGGGCATCAACGGGGTGGTGGACCTGGC

CAACCAGGCCGTGCAGCGGCAGATCAACAGCCGCCTGGACCCGGTGCCGCCCGCCGGCTCCGTGGAGATG

CCGCAGGTGAGGAGGAGCTGCCTCCCCTGGACAAGCGGGGCGAGAAGCGACCCCGCCCCGATGCGGAGG

AGACGCTGCTGACGCACACGGACGAGCCGCCCCCGTACGAGGAGGCGGTGAAACTGGGTCTGCCCACCAC

GCGGCCCATCGCGCCCCTGGCCACCGGGGTGCTGAAACCCGAAAAGCCCGCGACCCTGGACTTGCCTCCTC

CCCAGCCTTCCCGCCCCTCTACAGTGGCTAAGCCCCTGCCGCCGGTGGCCGTGGCCCGCGCGCGACCCGGG

GGCACCGCCCGCCCTCATGCGAACTGGCAGAGCACTCTGAACAGCATCGTGGGTCTGGGAGTGCAGAGTGT

GAAGCGCCGCCGCTGCTATTAAACCTACCGTAGCGCTTAACTTGCTTGTCTGTGTGTATGTATTATGTCG

CCGCCGCCGCTGTCCACCAGAAGGAGGAGTGAAGAGGCGCGTCGCCGAGTTGCAAGATGGCCACCCCATC

GATGCTGCCCCAGTGGGCGTACATGCACATCGCCGGACAGGACGCTTCGGAGTACCTGAGTCCGGGTCTGG

TGCAGTTTGCCCGCGCCACAGACACCTACTTCAGTCTGGGGAACAAGTTTAGGAACCCCACGGTGGCGCCC

ACGCACGATGTGACCACCGACCGCAGCCAGCGGCTGACGCTGCGCTTCGTGCCCGTGGACCGCGAGGACA

ACACCTACTCGTACAAAGTGCGCTACACGCTGGCCGTGGGCGACAACCGCGTGCTGGACATGGCCAGCACC

TACTTTGACATCCGCGGCGTGCTGGATCGGGGCCCTAGCTTCAAACCCTACTCCGGCACCGCCTACAACAG

TCTGGCCCCCAAGGGAGCACCCAACACTTGTCAGTGGACATATAAAGCCGATGGTGAAACTGCCACAGAA

AAAACCTATACATATGGAAATGCACCCGTGCAGGGCATTAACATCACAAAAGATGGTATTCAACTTGGAAC

TGACACCGATGATCAGCCAATCTACGCAGATAAAACCTATCAGCCTGAACCTCAAGTGGGTGATGCTGAAT

GGCATGACATCACTGGTACTGATGAAAAGTATGGAGGCAGAGCTCTTAAGCCTGATACCAAAATGAAGCCT

TGTTATGGTTCTTTTGCCAAGCCTACTAATAAAGAAGGAGGTCAGGCAAATGTGAAAACAGGAACAGGCAC

TACTAAAGAATATGACATAGACATGGCTTTCTTTGACAACAGAAGTGCGGCTGCTGCTGGCCTAGCTCCAG

AAATTGTTTTGTATACTGAAAATGTGGATTTGGAAACTCCAGATACCCATATTGTATACAAAGCAGGCACA

GATGACAGCAGCTCTTCTATTAATTTGGGTCAGCAAGCCATGCCCAACAGACCTAACTACATTGGTTTCAGA

GACAACTTTATCGGGCTCATGTACTACAACAGCACTGGCAATATGGGGGTGCTGGCCGGTCAGGCTTCTCA
```

```
GCTGAATGCTGTGGTTGACTTGCAAGACAGAAACACCGAGCTGTCCTACCAGCTCTTGCTTGACTCTCTGGG
TGACAGAACCCGGTATTTCAGTATGTGGAATCAGGCGGTGGACAGCTATGATCCTGATGTGCGCATTATTG
AAAATCATGGTGTGGAGGATGAACTTCCCAACTATTGTTTCCCTCTGGATGCTGTTGGCAGAACAGATACTT
ATCAGGGAATTAAGGCTAATGGAACTGATCAAACCACATGGACCAAAGATGACAGTGTCAATGATGCTAA
TGAGATAGGCAAGGGTAATCCATTCGCCATGGAAATCAACATCCAAGCCAACCTGTGGAGGAACTTCCTCT
ACGCCAACGTGGCCCTGTACCTGCCCGACTCTTACAAGTACACGCCGGCCAATGTTACCCTGCCCACCAAC
ACCAACACCTACGATTACATGAACGGCCGGGTGGTGGCGCCCTCGCTGGTGGACTCCTACATCAACATCGG
GGCGCGCTGGTCGCTGGATCCCATGGACAACGTGAACCCCTTCAACCACCACCGCAATGCGGGGCTGCGCGT
ACCGCTCCATGCTCCTGGGCAACGGGCGCTACGTGCCCTTCCACATCCAGGTGCCCCAGAAATTTTTCGCCA
TCAAGAGCCTCCTGCTCCTGCCCGGGTCCTACACCTACGAGTGGAACTTCCGCAAGGACGTCAACATGATC
CTGCAGAGCTCCCTCGGCAACGACCTGCGCACGGACGGGCCTCCATCTCCTTCACCAGCATCAACCTCTA
CGCCACCTTCTTCCCCATGGCGCACAACACGGCCTCCACGCTCGAGGCCATGCTGCGCAACGACACCAACG
ACCAGTCCTTCAACGACTACCTCTCGGCGGCCAACATGCTCTACCCCATCCCGGCCAACGCCACCAACGTG
CCCATCTCCATCCCCTCGCGCAACTGGGCCGCCTTCCGCGGCTGGTCCTTCACGCGTCTCAAGACCAAGGAG
ACGCCCTCGCTGGGCTCCGGGTTCGACCCCTACTTCGTCTACTCGGGCTCCATCCCCTACCTCGACGGCACC
TTCTACCTCAACCACACCTTCAAGAAGGTCTCCATCACCTTCGACTCCTCCGTCAGCTGGCCCGGCAACGAC
CGGCTCCTGACGCCCAACGAGTTCGAAATCAAGCGCACCGTCGACGGCGAGGGCTACAACGTGGCCCAGT
GCAACATGACCAAGGACTGGTTCCTGGTCCAGATGCTGGCCCACTACAACATCGGCTACCAGGGCTTCTAC
GTGCCCGAGGGTACAAGGACCGCATGTACTCCTTCTTCCGCAACTTCCAGCCCATGAGCCGCCAGGTGGT
GGACGAGGTCAACTACAAGGACTACCAGGCCGTCACCCTGGCCTACCAGCACAACAACTCGGGCTTCGTCG
GCTACCTCGCGCCCACCATGCGCCAGGGCCAGCCCTACCCCGCCAACTACCCCTACCCGCTCATCGGCAAG
AGCGCCGTCACCAGCGTCACCCAGAAAAAGTTCCTCTGCGACAGGGTCATGTGGCGCATCCCCTTCTCCAG
CAACTTCATGTCCATGGGCGCGCTCACCGACCTCGGCCAGAACATGCTCTATGCCAACTCCGCCCACGCGC
TAGACATGAATTTCGAAGTCGACCCCATGGATGAGTCCACCCTTCTCTATGTTGTCTTCGAAGTCTTCGACG
TCGTCCGAGTGCACCAGCCCCACCGCGGCGTCATCGAGGCCGTCTACCTGCGCACCCCCTTCTCGGCCGGT
AACGCCACCACCTAAGCTCTTGCTTCTTGCAAGCCATGGCCGCGGGCTCCGGCGAGCAGGAGCTCAGGGCC
ATCATCCGCGACCTGGGCTGCGGGCCCTACTTCCTGGGCACCTTCGATAAGCGCTTCCCGGGATTCATGGCC
CCGCACAAGCTGGCCTGCGCCATCGTCAACACGGCCGGCCGCGAGACCGGGGGCGAGCACTGGCTGGCCT
TCGCCTGGAACCCGCGCTCGAACACCTGCTACCTCTTCGACCCCTTCGGGTTCTCGGACGAGCGCCTCAAGC
AGATCTACCAGTTCGAGTACGAGGGCCTGCTGCGCCGCAGCGCCCTGGCCACCGAGGACCGCTGCGTCACC
CTGGAAAAGTCCACCCAGACCGTGCAGGGTCCGCGCTCGGCCGCCTGCGGGCTCTTCTGCTGCATGTTCCT
GCACGCCTTCGTGCACTGGCCCGCCGCCCCATGGACAAGAACCCCACCATGAACTTGCTGACGGGGGTGC
CCAACGGCATGCTCCAGTCGCCCCAGGTGGAACCCACCCTGCGCCGCAACCAGGAGGCGCTCTACCGCTTC
CTCAACTCCCACTCCGCCTACTTTCGCTCCCACCGCGCGCGCATCGAGAAGGCCACCGCCTTCGACCGCATG
AATCAAGACATGTAAACCGTGTGTATGTTAAATGTCTTTAATAAACAGCACTTTCATGTTACACATGCAT
CTGAGATGATTTATTTAGAAATCGAAAGGGTTCTGCCGGGTCTCGGCATGGCCCGCGGGCAGGGACACGTT
GCGGAACTGGTACTTGGCCAGCCACTTGAACTCGGGGATCAGCAGTTTGGGCAGCGGGGTGTCGGGGAAG
GAGTCGGTCCACAGCTTCCGCGTCAGTTGCAGGGCGCCCAGCAGGTCGGGCGCGGAGATCTTGAAATCGCA
GTTGGGACCCGCGTTCTGCGCGCGGGAGTTGCGGTACACGGGGTTGCAGCACTGGAACACCATCAGGGCCG
GGTGCTTCACGCTCGCCAGCACCGTCGCGTCGGTGATGCTCTCCACGTCGAGGTCCTCGGCGTTGGCCATCC
```

-continued

```
CGAAGGGGGTCATCTTGCAGGTCTGCCTTCCCATGGTGGGCACGCACCCGGGCTTGTGGTTGCAATCGCAG

TGCAGGGGATCAGCATCATCTGGGCCTGGTCGGCGTTCATCCCCGGGTACATGGCCTTCATGAAAGCCTC

CAATTGCCTGAACGCCTGCTGGGCCTTGGCTCCCTCGGTGAAGAAGACCCCGCAGGACTTGCTAGAGAACT

GGTTGGTGGCGCACCCGGCGTCGTGCACGCAGCAGCGCGCGTCGTTGTTGGCCAGCTGCACCACGCTGCGC

CCCCAGCGGTTCTGGGTGATCTTGGCCCGGTCGGGGTTCTCCTTCAGCGCGCGCTGCCCGTTCTCGCTCGCC

ACATCCATCTCGATCATGTGCTCCTTCTGGATCATGGTGGTCCCGTGCAGGCACCGCAGCTTGCCCTCGGCC

TCGGTGCACCCGTGCAGCCACAGCGCGCACCCGGTGCACTCCCAGTTCTTGTGGGCGATCTGGGAATGCGC

GTGCACGAAGCCCTGCAGGAAGCGGCCCATCATGGTGGTCAGGGTCTTGTTGCTAGTGAAGGTCAGCGGAA

TGCCGCGGTGCTCCTCGTTGATGTACAGGTGGCAGATGCGGCGGTACACCTCGCCCTGCTCGGGCATCAGC

TGGAAGTTGGCTTTCAGGTCGGTCTCCACGCGGTAGCGGTCCATCAGCATAGTCATGATTTCCATACCCTTC

TCCCAGGCCGAGACGATGGGCAGGCTCATAGGGTTCTTCACCATCATCTTAGCGCTAGCAGCCGCGGCCAG

GGGGTCGCTCTCGTCCAGGGTCTCAAAGCTCCGCTTGCCGTCCTTCTCGGTGATCCGCACCGGGGGGTAGCT

GAAGCCCACGGCCGCCAGCTCCTCCTCGGCCTGTCTTTCGTCCTCGCTGTCCTGGCTGACGTCCTGCAGGAC

CACATGCTTGGTCTTGCGGGGTTTCTTCTTGGGCGGCAGCGGCGGCGGAGATGTTGGAGATGGCGAGGGGG

AGCGCGAGTTCTCGCTCACCACTACTATCTCTTCCTCTTCTTGGTCCGAGGCCACGCGGCGGTAGGTATGTC

TCTTCGGGGGCAGAGGCGGAGGCGACGGGCTCTCGCCGCCGCGACTTGGCGGATGGCTGGCAGAGCCCCTT

CCGCGTTCGGGGGTGCGCTCCCGGCGGCGCTCTGACTGACTTCCTCCGCGGCCGGCCATTGTGTTCTCCTAG

GGAGGAACAACAAGCATGGAGACTCAGCCATCGCCAACCTCGCCATCTGCCCCACCGCCGACGAGAAGC

AGCAGCAGCAGAATGAAAGCTTAACCGCCCCGCCGCCCAGCCCCGCCACCTCCGACGCGGCCGTCCCAGA

CATGCAAGAGATGGAGGAATCCATCGAGATTGACCTGGGCATATGTGACGCCCGCGGAGCACGAGGAGGAG

CTGGCAGTGCGCTTTTCACAAGAAGAGATACACCAAGAACAGCCAGAGCAGGAAGCAGAGAATGAGCAGA

GTCAGGCTGGGCTCGAGCATGACGGCGACTACCTCCACCTGAGCGGGGGGAGGACGCGCTCATCAAGCA

TCTGGCCCGGCAGGCCACCATCGTCAAGGATGCGCTGCTCGACCGCACCGAGGTGCCCCTCAGCGTGGAGG

AGCTCAGCCGCGCCTACGAGTTGAACCTCTTCTCGCCGCGCGTGCCCCCCAAGCGCCAGCCCAATGGCACC

TGCGAGCCCAACCCGCGCCTCAACTTCTACCCGGTCTTCGCGGTGCCCGAGGCCCTGGCCACCTACCACATC

TTTTTCAAGAACCAAAAGATCCCCGTCTCCTGCCGCGCCAACCGCACCCGCGCCGACGCCCTTTTCAACCTG

GGTCCCGGCGCCCGCCTACCTGATATCGCCTCCTTGGAAGAGGTTCCCAAGATCTTCGAGGGTCTGGGCAG

CGACGAGACTCGGGCCGCGAACGCTCTGCAAGGAGAAGGAGGAGAGCATGAGCACCACACGCGCCCTGGTC

GAGTTGGAAGGCGACAACGCGCGGCTGGCGGTGCTCAAACGCACGGTCGAGCTGACCCATTTCGCCTACCC

GGCTCTGAACCTGCCCCCCAAAGTCATGAGCGCGGTCATGGACCAGGTGCTCATCAAGCGCGCGTCGCCCA

TCTCCGAGGACGAGGGCATGCAAGACTCCGAGGAGGGCAAGCCCGTGGTCAGCGACGAGCAGCTGGCCCG

GTGGCTGGGTCCTAATGCTAGTCCCCAGAGTTTGGAAGAGCGGCGCAAACTCATGATGGCCGTGGTCCTGG

TGACCGTGGAGCTGGAGTGCCTGCGCCGCTTCTTCGCCGACGCGGAGACCCTGCGCAAGGTCGAGGAGAAC

CTGCACTACCTCTTCAGGCACGGGTTCGTGCGCCAGGCCTGCAAGATCTCCAACGTGGAGCTGACCAACCT

GGTCTCCTACATGGGCATCTTGCACGAGAACCGCCTGGGGCAGAACGTGCTGCACACCACCCTGCGCGGGG

AGGCCCGGCGCGACTACATCCGCGACTGCGTCTACCTCTACCTCTGCCACACCTGGCAGACGGGCATGGC

GTGTGGCAGCAGTGTCTGGAGGAGCAGAACCTGAAAGAGCTCTGCAAGCTCCTGCAGAAGAACCTCAAGG

GTCTGTGGACCGGGTTCGACGAGCGCACCACCGCCTCGGACCTGGCCGACCTCATTTTCCCCGAGCGCCTC

AGGCTGACGCTGCGCAACGGCCTGCCCGACTTTATGAGCCAAAGCATGTTGCAAAACTTTCGCTCTTTCATC

CTCGAACGCTCCGGAATCCTGCCCGCCACCTGCTCCGCGCTGCCCTCGGACTTCGTGCCGCTGACCTTCCGC

GAGTGCCCCCCGCCGCTGTGGAGCCACTGCTACCTGCTGCGCCTGGCCAACTACCTGGCCTACCACTCGGA
```

-continued

```
CGTGATCGAGGACGTCAGCGGCGAGGGCCTGCTCGAGTGCCACTGCCGCTGCAACCTCTGCACGCCGCACC

GCTCCCTGGCCTGCAACCCCCAGCTGCTGAGCGAGACCCAGATCATCGGCACCTTCGAGTTGCAAGGGCCC

AGCGAAGGCGAGGGTTCAGCCGCCAAGGGGGGTCTGAAACTCACCCCGGGGCTGTGGACCTCGGCCTACT

TGCGCAAGTTCGTGCCCGAGGACTACCATCCCTTCGAGATCAGGTTCTACGAGGACCAATCCCATCCGCCC

AAGGCCGAGCTGTCGGCCTGCGTCATCACCCAGGGGGCGATCCTGGCCCAATTGCAAGCCATCCAGAAATC

CCGCCAAGAATTCTTGCTGAAAAAGGGCCGCGGGGTCTACCTCGACCCCCAGACCGGTGAGGAGCTCAACC

CCGGCTTCCCCCAGGATGCCCCGAGGAAACAAGAAGCTGAAAGTGGAGCTGCCGCCCGTGGAGGATTTGG

AGGAAGACTGGGAGAACAGCAGTCAGGCAGAGGAGGAGGAGATGGAGGAAGACTGGGACAGCACTCAGG

CAGAGGAGGACAGCCTGCAAGACAGTCTGGAGGAAGACGAGGAGGAGGCAGAGGAGGAGGTGGAAGAAG

CAGCCGCCGCCAGACCGTCGTCCTCGGCGGGGAGAAAGCAAGCAGCACGGATACCATCTCCGCTCCGGG

TCGGGGTCCCGCTCGACCACACAGTAGATGGGACGAGACCGGACGATTCCCGAACCCCACCACCCAGACC

GGTAAGAAGGAGCGGCAGGGATACAAGTCCTGGCGGGGGCACAAAAACGCCATCGTCTCCTGCTTGCAGG

CCTGCGGGGCAACATCTCCTTCACCCGGCGCTACCTGCTCTTCCACCGCGGGGTGAACTTTCCCCGCAACA

TCTTGCATTACTACCGTCACCTCCACAGCCCCTACTACTTCCAAGAAGAGGCAGCAGCAGCAGAAAAAGAC

CAGCAGAAAACCAGCAGCTAGAAAATCCACAGCGGCGGCAGCAGGTGGACTGAGGATCGCGGCGAACGA

GCCGGCGCAAACCCGGGAGCTGAGGAACCGGATCTTTCCCACCCTCTATGCCATCTTCCAGCAGAGTCGGG

GGCAGGAGCAGGAACTGAAAGTCAAGAACCGTTCTCTGCGCTCGCTCACCCGCAGTTGTCTGTATCACAAG

AGCGAAGACCAACTTCAGCGCACTCTCGAGGACGCCGAGGCTCTCTTCAACAAGTACTGCGCGCTCACTCT

TAAAGAGTAGCCCGCGCCCGCCAGTCGCAGAAAAAGGCGGGAATTACGTCACCTGTGCCCTTCGCCCTAG

CCGCCTCCACCCATCATCATGAGCAAAGAGATTCCCACGCCTTACATGTGGAGCTACCAGCCCCAGATGGG

CCTGGCCGCCGGTGCCGCCCAGGACTACTCCACCCGCATGAATTGGCTCAGCGCCGGGCCCGCGATGATCT

CACGGGTGAATGACATCCGCGCCCACCGAAACCAGATACTCCTAGAACAGTCAGCGCTCACCGCCACGCCC

CGCAATCACCTCAATCCGCGTAATTGGCCCGCCGCCCTGGTGTACCAGGAAATTCCCCAGCCCACGACCGT

ACTACTTCCGCGAGACGCCCAGGCCGAAGTCCAGCTGACTAACTCAGGTGTCCAGCTGGCGGGCGGCGCCA

CCCTGTGTCGTCACCGCCCCGCTCAGGGTATAAAGCGGCTGGTGATCCGGGGCAGAGGCACACAGCTCAAC

GACGAGGTGGTGAGCTCTTCGCTGGGTCTGCGACCTGACGGAGTCTTCCAACTCGCCGGATCGGGGAGATC

TTCCTTCACGCCTCGTCAGGCCGTCCTGACTTTGGAGAGTTCGTCCTCGCAGCCCCGCTCGGGTGGCATCGG

CACTCTCCAGTTCGTGGAGGAGTTCACTCCCTCGGTCTACTTCAACCCCTTCTCCGGCTCCCCCGGCCACTA

CCCGGACGAGTTCATCCCGAACTTCGACGCCATCAGCGAGTCGGTGGACGGCTACGATTGAAACTAATCAC

CCCCTTATCCAGTGAAATAAAGATCATATTGATGATGATTTTACAGAAATAAAAAATAATCATTTGATTTGA

AATAAAGATACAATCATATTGATGATTTGAGTTTAACAAAAAAATAAAGAATCACTTACTTGAAATCTGAT

ACCAGGTCTCTGTCCATGTTTTCTGCCAACACCACTTCACTCCCCTCTTCCCAGCTCTGGTACTGCAGGCCCC

GGCGGGCTGCAAACTTCCTCCACACGCTGAAGGGGATGTCAAATTCCTCCTGTCCCTCAATCTTCATTTTAT

CTTCTATCAGATGTCCAAAAAGCGCGTCCGGGTGGATGATGACTTCGACCCCGTCTACCCCTACGATGCAG

ACAACGCACCGACCGTGCCCTTCATCAACCCCCCCTTCGTCTCTTCAGATGGATTCCAAGAGAAGCCCCTGG

GGGTGTTGTCCCTGCGACTGGCCGACCCCGTCACCACCAAGAACGGGGAAATCACCCTCAAGCTGGGAGA

GGGGGTGGACCTCGATTCCTCGGGAAAACTCATCTCCAACACGGCCACCAAGGCCGCCGCCCCTCTCAGTT

TTTCCAACAACACCATTTCCCTTAACATGGATCACCCCTTTTACACTAAAGATGGAAAATTATCCTTACAAG

TTTCTCCACCATTAAATATACTGAGAACAAGCATTCTAAACACACTAGCTTTAGGTTTTGGATCAGGTTTAG

GACTCCGTGGCTCTGCCTTGGCAGTACAGTTAGTCTCTCCACTTACATTTGATACTGATGGAAACATAAAGC
```

-continued

```
TTACCTTAGACAGAGGTTTGCATGTTACAACAGGAGATGCAATTGAAAGCAACATAAGCTGGGCTAAAGGT

TTAAAATTTGAAGATGGAGCCATAGCAACCAACATTGGAAATGGGTTAGAGTTTGGAAGCAGTAGTACAG

AAACAGGTGTTGATGATGCTTACCCAATCCAAGTTAAACTTGGATCTGGCCTTAGCTTTGACAGTACAGGA

GCCATAATGGCTGGTAACAAAGAAGACGATAAACTCACTTTGTGGACAACACCTGATCCATCACCAAACTG

TCAAATACTCGCAGAAAATGATGCAAAACTAACACTTTGCTTGACTAAATGTGGTAGTCAAATACTGGCCA

CTGTGTCAGTCTTAGTTGTAGGAAGTGGAAACCTAAACCCCATTACTGGCACCGTAAGCAGTGCTCAGGTG

TTTCTACGTTTTGATGCAAACGGTGTTCTTTTAACAGAACATTCTACACTAAAAAAATACTGGGGGTATAGG

CAGGGAGATAGCATAGATGGCACTCCATATACCAATGCTGTAGGATTCATGCCCAATTTAAAAGCTTATCC

AAAGTCACAAAGTTCTACTACTAAAAATAATATAGTAGGGCAAGTATACATGAATGGAGATGTTTCAAAAC

CTATGCTTCTCACTATAACCCTCAATGGTACTGATGACAGCAACAGTACATATTCAATGTCATTTTCATACA

CCTGGACTAATGGAAGCTATGTTGGAGCAACATTTGGGGCTAACTCTTATACCTTCTCATACATCGCCCAAG

AATGAACACTGTATCCCACCCTGCATGCCAACCCTTCCCACCCCACTCTGTGGAACAAACTCTGAAACACA

AAATAAAATAAAGTTCAAGTGTTTTATTGATTCAACAGTTTTACAGGATTCGAGCAGTTATTTTTCCTCCAC

CCTCCCAGGACATGGAATACACCACCCTCTCCCCCCGCACAGCCTTGAACATCTGAATGCCATTGGTGATG

GACATGCTTTTGGTCTCCACGTTCCACACAGTTTCAGAGCGAGCCAGTCTCGGGTCGGTCAGGGAGATGAA

ACCCTCCGGGCACTCCCGCATCTGCACCTCACAGCTCAACAGCTGAGGATTGTCCTCGGTGGTCGGATCA

CGGTTATCTGGAAGAAGCAGAAGAGCGGCGGTGGGAATCATAGTCCGCGAACGGGATCGGCCGGTGGTGT

CGCATCAGGCCCCGCAGCAGTCGCTGCCGCCGCCGCTCCGTCAAGCTGCTGCTCAGGGGGTCCGGGTCCAG

GGACTCCCTCAGCATGATGCCCACGGCCCTCAGCATCAGTCGTCGGTGCGGCGGGCGCAGCAGCGCATGC

GGATCTCGCTCAGGTCGCTGCAGTACGTGCAACACAGAACCACCAGGTTGTTCAACAGTCCATAGTTCAAC

ACGCTCCAGCCGAAACTCATCGCGGGAAGGATGCTACCCACGTGGCCGTCGTACCAGATCCTCAGGTAAT

CAAGTGGTGCCCCCTCCAGAACACGCTGCCCACGTACATGATCTCCTTGGGCATGTGGCGGTTCACCACCTC

CCGGTACCACATCACCCTCTGGTTGAACATGCAGCCCCGGATGATCCTGCGGAACCACAGGGCCAGCACCG

CCCCGCCCGCCATGCAGCGAAGAGACCCCGGGTCCCGGCAATGGCAATGGAGGACCCACCGCTCGTACCC

GTGGATCATCTGGGAGCTGAACAAGTCTATGTTGGCACAGCACAGGCATATGCTCATGCATCTCTTCAGCA

CTCTCAACTCCTCGGGGGTCAAAACCATATCCCAGGGCACGGGGAACTCTTGCAGGACAGCGAACCCCGCA

GAACAGGGCAATCCTCGCACAGAACTTACATTGTGCATGGACAGGGTATCGCAATCAGGCAGCACCGGGT

GATCCTCCACCAGAGAAGCGCGGGTCTCGGTCTCCTCACAGCGTGGTAAGGGGCCGGCCGATACGGGTG

ATGGCGGGACGCGGCTGATCGTGTTCGCGACCGTGTCATGATGCAGTTGCTTTCGGACATTTTCGTACTTGC

TGTAGCAGAACCTGGTCCGGGCGCTGCACACCGATCGCCGGCGGCGGTCTCGGCGCTTGGAACGCTCGGTG

TTGAAATTGTAAAACAGCCACTCTCTCAGACCGTGCAGCAGATCTAGGGCCTCAGGAGTGATGAAGATCCC

ATCATGCCTGATGGCTCTGATCACATCGACCACCGTGGAATGGGCCAGACCCAGCCAGATGATGCAATTTT

GTTGGGTTTCGGTGACGGCGGGGAGGGAAGAACAGGAAGAACCATGATTAACTTTTAATCCAAACGGTCT

CGGAGTACTTCAAAATGAAGATCGCGGAGATGGCACCTCTCGCCCCCGCTGTGTTGGTGGAAAATAACAGC

CAGGTCAAAGGTGATACGGTTCTCGAGATGTTCCACGGTGGCTTCCAGCAAAGCCTCCACGCGCACATCCA

GAAACAAGACAATAGCGAAAGCGGGAGGGTTCTCTAATTCCTCAATCATCATGTTACACTCCTGCACCATC

CCCAGATAATTTTCATTTTTCCAGCCTTGAATGATTCGAACTAGTTCCTGAGGTAAATCCAAGCCAGCCATG

ATAAAGAGCTCGCGCAGAGCGCCCTCCACCGGCATTCTTAAGCACACCCTCATAATTCCAAGATATTCTGC

TCCTGGTTCACCTGCAGCAGATTGACAGCGGAATATCAAAATCTCTGCCGCGATCCCTGAGCTCCTCCCTC

AGCAATAACTGTAAGTACTCTTTCATATCCTCTCCGAAATTTTTAGCCATAGGACCACCAGGAATAAGATTA

GGGCAAGCCACAGTACAGATAAACCGAAGTCCTCCCCAGTGAGCATTGCCAAATGCAAGACTGCTATAAG
```

-continued

CATGCTGGCTAGACCCGGTGATATCTTCCAGATAACTGGACAGAAAATCGCCCAGGCAATTTTTAAGAAAA

TCAACAAAGAAAAATCCTCCAGGTGGACGTTTAGAGCCTCGGGAACAACGATGAAGTAAATGCAAGCGG

TGCGTTCCAGCATGGTTAGTTAGCTGATCTGTAGAAAAAACAAAAATGAACATTAAACCATGCTAGCCTGG

CGAACAGGTGGGTAAATCGTTCTCTCCAGCACCAGGCAGGCCACGGGGTCTCCGGCGCGACCCTCGTAAAA

ATTGTCGCTATGATTGAAAACCATCACAGAGAGACGTTCCCGGTGGCCGGCGTGAATGATTCGACAAGATG

AATACACCCCCGGAACATTGGCGTCCGCGAGTGAAAAAAAGCGCCCGAGGAAGCAATAAGGCACTACAAT

GCTCAGTCTCAAGTCCAGCAAAGCGATGCCATGCGGATGAAGCACAAAATTCTCAGGTGCGTACAAAATGT

AATTACTCCCCTCCTGCACAGGCAGCAAAGCCCCGATCCCTCCAGGTACACATACAAAGCCTCAGCGTCC

ATAGCTTACCGAGCAGCAGCACACAACAGGCGCAAGAGTCAGAGAAAGGCTGAGCTCTAACCTGTCCACC

CGCTCTCTGCTCAATATATAGCCCAGATCTACACTGACGTAAAGGCCAAAGTCTAAAAATACCCGCCAAAT

AATCACACACGCCCAGCACACGCCCAGAAACCGGTGACACACTCAAAAAAATACGCGCACTTCCTCAAAC

GCCCAAAACTGCCGTCATTTCCGGGTTCCCACGCTACGTCATCAAAACACGACTTTCAAATTCCGTCGACCG

TTAAAAACGTCACCCGCCCCGCCCCTAACGGTCGCCCGTCTCTCAGCCAATCAGCGCCCCGCATCCCCAAA

TTCAAACACCTCATTTGCATATTAACGCGCACAAAAAGTTTGAGGTATATTATTGATGATG

ChAdV68-E4d-CMT-TSNA (SEQ ID NO: 69)
CATCATCAATAATATACCTCAAACTTTTTGTGCGCGTTAATATGCAAATGAGGCGTTTGAATTTGGGGAGGA

AGGGCGGTGATTGGTCGAGGGATGAGCGACCGTTAGGGGCGGGGCGAGTGACGTTTTGATGACGTGGTTG

CGAGGAGGAGCCAGTTTGCAAGTTCTCGTGGGAAAAGTGACGTCAAACGAGGTGTGGTTTGAACACGGAA

ATACTCAATTTTCCCGCGCTCTCTGACAGGAAATGAGGTGTTTCTGGGCGGATGCAAGTGAAAACGGGCCA

TTTTCGCGCGAAAACTGAATGAGGAAGTGAAAATCTGAGTAATTTCGCGTTTATGGCAGGGAGGAGTATTT

GCCGAGGGCCGAGTAGACTTTGACCGATTACGTGGGGGTTTCGATTACCGTGTTTTTCACCTAAATTTCCGC

GTACGGTGTCAAAGTCCGGTGTTTTTACGTAGGTGTCAGCTGATCGCCAGGGTATTTAAACCTGCGCTCTCC

AGTCAAGAGGCCACTCTTGAGTGCCAGCGAGAAGAGTTTTCTCCTCCGCGCCGCGAGTCAGATCTACACTT

TGAAAGTAGGGATAACAGGGTAATGACATTGATTATTGACTAGTTGTTAATAGTAATCAATTACGGGGTCA

TTAGTTCATAGCCCATATATGGAGTTCCGCGTTACATAACTTACGGTAAATGGCCCGCCTGGCTGACCGCCC

AACGACCCCCGCCCATTGACGTCAATAATGACGTATGTTCCCATAGTAACGCCAATAGGGACTTTCCATTG

ACGTCAATGGGTGGAGTATTTACGGTAAACTGCCCACTTGGCAGTACATCAAGTGTATCATATGCCAAGTC

CGCCCCCTATTGACGTCAATGACGGTAAATGGCCCGCCTGGCATTATGCCCAGTACATGACCTTACGGGAC

TTTCCTACTTGGCAGTACATCTACGTATTAGTCATCGCTATTACCATGGTGATGCGGTTTTGGCAGTACACC

AATGGGCGTGGATAGCGGTTTGACTCACGGGGATTTCCAAGTCTCCACCCCATTGACGTCAATGGGAGTTT

GTTTTGGCACCAAAATCAACGGGACTTTCCAAAATGTCGTAATAACCCCGCCCCGTTGACGCAAATGGGCG

GTAGGCGTGTACGGTGGGAGGTCTATATAAGCAGAGCTCTCCCTATCAGTGATAGAGATCTCCCTATCAGT

GATAGAGATCGTCGACGAGCTCGTTTAGTGAACCGTCAGATCGCCTGGAACGCCATCCACGCTGTTTTGAC

CTCCATAGAAGACAGCGATCGCGCCACCATGGCTGGCATGACCGAGTACAAGCTAGTCGTTGTGGGAGCTG

GAGATGTGGGCAAATCTGCTCTGACCATTCAGCTGATTCAGGGCACAGATCTGGATCACCAGGAGAAGTGT

CTGAGCAGGCTGTACGACCACATGCCAGAAGGATTAACCCCTCTTATGGGAGTGAGCTCTTCTTCTGCTCTG

GCCAGACTGGGACTGCCTATGGATAAGCTGAACAAGATCACAGCTCCTGCCTCTCAGAAACTGAGACAGCT

GCAGAAGATGGAGACCCCTGAACTGCTGCCTTGTGGATATCTGGTGGAGGAGAATACCACAATCAGCGTGA

CCGTGAAAGGCCTGGAAGCCCAGAAACAAGATCAAAGGCTGTACCGGCTCTGTGAATATGACACTGCAGAG

AGCTTCTGCCGCCCCTAAGACAGGAGGAGGAGGAGAAGCTGCTGCCTACAATAATACATTAGTGGCCAGA

CATGTGCCCCAGATCCCTAAGCCTGACAGCCTGGTTGGCCTGAGCGATGAATTAGGAAAAAGAGACACATT

-continued

```
TGCCGAGAGCCTGATCCGGAGAATGGCCTCTGCCGGCTACCTGTTCCTGGATATCATCACATATGTTGTGTT

TGCCGTGACCTTCGTGCTGGGAGTTCTGGGCGGCCTGAATACCGAGACCAATGAAAAAGCTCTTGAAGCCG

TGTTTGGCAAGTACGGCAGAATCGTGGAGGTGCTGGGCGGCAGATCTTGTGAAGAATTAACAGCTGTGTTA

CCACCTCCTCAGCTGCTTGGCAGACGGTTCAACTTCTTCAGCTACAGCTACGTTGCTGCTGGCTCTTCTGGC

AACAACTACGACCTGATGGCCCAGCCTATTACACCTGGACCTGATACAACACCTCTGCCTGTGACCGATAC

ATCTTCTGTGTCTACCGGACACGCCACATCTCTGCCAGTGACAGATGCTGGACTGAGAGTGACAGAGTCTA

AAGGACACAGCGATTCTTGGCACCTGAGCCTGGATACAGCCATCAGGGTGAATACCCCTAAGCTGGTTTCT

GAAGTGGAAGAGCTGAACAAGAGCATCACCGCCCTGAGGGAGAAGTTACTGCAGATGGTGGAAGCCGATA

GACCTGGAAACCTGTTTATTGGAGGCCTGAACACCGAGACCAATGAGGACTCTCCCGTGAAGGATGAAGTG

GTGGTGAACGATCAATGGGCCAGAATTGTAGCTGCCATCATGGAGGCTACGAGTTCCCTGATCTGCACAG

GACAATCGTGTCTGAGTGCGATGTGTATCTGACCTACATGCTGAGACAGGCTGCTCTGCAGCTGTTCTTCGA

CCTGTATCACAGCATCCCTAGCAGCTTTTCTCCTCTGGTTCTGAGCTGTCTGGTGCAGCCTCTGGAAGATGT

GGAAGTGATGGAGAAGGATGGCACAACCTTTAGCTGTGAGGTGAGCCACGATGAGGTGCCTCGGACATAT

GGACCCGTGTTTATGTGTCTGGGAGGACTGCTGACCATGGTGGCTGGAGCTGTTTGGCTGACAGTTGGACC

CGGACCAGGCGCCAAATTTGTTGCTGCTTGGACACTGAAAGCTGCTGCTGGGCCCGGACCAGGCCAGTACA

TCAAGGCCAACTCTAAGTTTATCGGCATCACCGAATTGGGACCTGGACCCGGCTAGTAGTGAGTTTAAACT

CCCATTTAAATGTGAGGGTTAATGCTTCGAGCAGACATGATAAGATACATTGATGAGTTTGGACAAACCAC

AACTAGAATGCAGTGAAAAAAATGCTTTATTTGTGAAATTTGTGATGCTATTGCTTTATTTGTAACCATTAT

AAGCTGCAATAAACAAGTTAACAACAACAATTGCATTCATTTTATGTTTCAGGTTCAGGGGGAGATGTGGG

AGGTTTTTTAAAGCAAGTAAAACCTCTACAAATGTGGTAAAATAACTATAACGGTCCTAAGGTAGCGAGTG

AGTAGTGTTCTGGGGCGGGGAGGACCTGCATGAGGGCCAGAATAACTGAAATCTGTGCTTTTCTGTGTGT

TGCAGCAGCATGAGCGGAAGCGGCTCCTTTGAGGGAGGGGTATTCAGCCCTTATCTGACGGGCGTCTCCC

CTCCTGGGCGGGAGTGCGTCAGAATGTGATGGGATCCACGGTGGACGGCCGGCCCGTGCAGCCCGCGAAC

TCTTCAACCCTGACCTATGCAACCCTGAGCTCTTCGTCGTTGGACGCAGCTGCCGCCGCAGCTGCTGCATCT

GCCGCAGCGCCGTGCGCGGAATGGCCATGGGCGCCGGCTACTACGGCACTCTGGTGGCCAACTCGAGTTC

CACCAATAATCCCGCCAGCCTGAACGAGGAGAAGCTGTTGCTGCTGATGGCCCAGCTCGAGGCCTTGACCC

AGCGCCTGGGCGAGCTGACCCAGCAGGTGGCTCAGCTGCAGGAGCAGACGCGGGCCGCGGTTGCCACGGT

GAAATCCAAATAAAAAATGAATCAATAAATAAACGGAGACGGTTGTTGATTTTAACACAGAGTCTGAATCT

TTATTTGATTTTTCGCGCGCGGTAGGCCCTGGACCACCGGTCTCGATCATTGAGCACCCGGTGGATCTTTTC

CAGGACCCGGTAGAGGTGGGCTTGGATGTGAGGTACATGGGCATGAGCCCGTCCCGGGGGTGGAGGTAG

CTCCATTGCAGGGCCTCGTGCTCGGGGTGGTGTTGTAAATCACCCAGTCATAGCAGGGGCAGGGCATG

GTGTTGCACAATATCTTTGAGGAGGAGACTGATGGCCACGGGCAGCCCTTTGGTGTAGGTGTTTACAAATC

TGTTGAGCTGGGAGGGATGCATGCGGGGGAGATGAGGTGCATCTTGGCCTGGATCTTGAGATTGGCGATG

TTACCGCCCAGATCCCGCCTGGGGTTCATGTTGTGCAGGACCACCAGCACGGTGTATCCGGTGCACTTGGG

GAATTTATCATGCAACTTGGAAGGGAAGGCGTGAAAGAATTTGGCGACGCCTTTGTGCCCGCCCAGGTTTT

CCATGCACTCATCCATGATGATGGCGATGGGCCCGTGGGCGGCGGCCTGGGCAAAGACGTTTCGGGGGTCG

GACACATCATAGTTGTGGTCCTGGGTGAGGTCATCATAGGCCATTTTAATGAATTTGGGCGGAGGGTGCC

GGACTGGGGGACAAGGTTCCCTCGATCCCGGGGCGTAGTTCCCCTCACAGATCTGCATCTCCCAGGCTT

TGAGCTCGGAGGGGGGATCATGTCCACCTGCGGGGCGATAAAGAACACGGTTTCCGGGGCGGGGGAGAT

GAGCTGGGCCGAAAGCAAGTTCCGGAGCAGCTGGGACTTGCCGCAGCCGGTGGGGCCGTAGATGACCCCG
```

-continued
ATGACCGGCTGCAGGTGGTAGTTGAGGGAGAGACAGCTGCCGTCCTCCCGGAGGAGGGGGCCACCTCGT

TCATCATCTCGCGCACGTGCATGTTCTCGCGCACCAGTTCCGCCAGGAGGCGCTCTCCCCCCAGGGATAGG

AGCTCCTGGAGCGAGGCGAAGTTTTTCAGCGGCTTGAGTCCGTCGGCCATGGGCATTTTGGAGAGGGTTTG

TTGCAAGAGTTCCAGGCGGTCCCAGAGCTCGGTGATGTGCTCTACGCATCTCGATCCAGCAGACCTCCTC

GTTTCGCGGGTTGGGACGGCTGCGGGAGTAGGGCACCAGACGATGGGCGTCCAGCGCAGCCAGGGTCCGG

TCCTTCCAGGGTCGCAGCGTCCGCGTCAGGGTGGTCTCCGTCACGGTGAAGGGGTGCGCGCCGGGCTGGGC

GCTTGCGAGGGTGCGCTTCAGGCTCATCCGGCTGGTCGAAAACCGCTCCCGATCGGCGCCCTGCGCGTCGG

CCAGGTAGCAATTGACCATGAGTTCGTAGTTGAGCGCCTCGGCCGCGTGGCCTTTGGCGCGGAGCTTACCTT

TGGAAGTCTGCCCGCAGGCGGGACAGAGGAGGGACTTGAGGGCGTAGAGCTTGGGGGCGAGGAAGACGG

ACTCGGGGCGTAGGCGTCCGCGCCGCAGTGGGCGCAGACGGTCTCGCACTCCACGAGCCAGGTGAGGTC

GGGCTGGTCGGGGTCAAAAACCAGTTTCCCGCCGTTCTTTTTGATGCGTTTCTTACCTTTGGTCTCCATGAGC

TCGTGTCCCCGCTGGGTGACAAAGAGGCTGTCCGTGCCCGTAGACCGACTTTATGGGCCGGTCCTCGAG

CGGTGTGCCGCGGTCCTCCTCGTAGAGGAACCCCGCCCACTCCGAGACGAAAGCCCGGGTCCAGGCCAGCA

CGAAGGAGGCCACGTGGGACGGGTAGCGGTCGTTGTCCACCAGCGGGTCCACCTTTTCCAGGGTATGCAAA

CACATGTCCCCCTCGTCCACATCCAGGAAGGTGATTGGCTTGTAAGTGTAGGCCACGTGACCGGGGGTCCC

GGCCGGGGGGGTATAAAAGGGTGCGGGTCCCTGCTCGTCCTCACTGTCTTCCGGATCGCTGTCCAGGAGCG

CCAGCTGTTGGGGTAGGTATTCCCTCTCGAAGGCGGGCATGACCTCGGCACTCAGGTTGTCAGTTTCTAGAA

ACGAGGAGGATTTGATATTGACGGTGCCGGCGGAGATGCCTTTCAAGAGCCCCTCGTCCATCTGGTCAGAA

AAGACGATCTTTTTGTTGTCGAGCTTGGTGGCGAAGGAGCCGTAGAGGGCGTTGGAGAGGAGCTTGGCGAT

GGAGCGCATGGTCTGGTTTTTTTCCTTGTCGGCGCGCTCCTTGGCGGCGATGTTGAGCTGCACGTACTCGCG

CGCCACGCACTTCCATTCGGGGAAGACGGTGGTCAGCTCGTCGGGCACGATTCTGACCTGCCAGCCCCGAT

TATGCAGGGTGATGAGGTCCACACTGGTGGCCACCTCGCCGCGCAGGGGCTCATTAGTCCAGCAGAGGCGT

CCGCCCTTGCGCGAGCAGAAGGGGGGCAGGGGTCCAGCATGACCTCGTCGGGGGGTCGGCATCGATGG

TGAAGATGCCGGGCAGGAGGTCGGGGTCAAAGTAGCTGATGGAAGTGGCCAGATCGTCCAGGGCAGCTTG

CCATTCGCGCACGGCCAGCGCGCGCTCGTAGGGACTGAGGGGCGTGCCCAGGGCATGGGATGGGTAAGC

GCGGAGGCGTACATGCCGCAGATGTCGTAGACGTAGAGGGGCTCCTCGAGGATGCCGATGTAGGTGGGGT

AGCAGCGCCCCCGCGGATGCTGGCGCGCACGTAGTCATACAGCTCGTGCGAGGGGCGAGGAGCCCCGG

GCCCAGGTTGGTGCGACTGGGCTTTTCGGCGCGGTAGACGATCTGGCGGAAAATGGCATGCGAGTTGGAGG

AGATGGTGGGCCTTTGGAAGATGTTGAAGTGGGCGTGGGGCAGTCCGACCGAGTCGCGGATGAAGTGGGC

GTAGGAGTCTTGCAGCTTGGCGACGAGCTCGGCGGTGACTAGGACGTCCAGAGCGCAGTAGTCGAGGGTCT

CCTGGATGATGTCATACTTGAGCTGTCCCTTTTGTTTCCACAGCTCGCGGTTGAGAAGGAACTCTTCGCGGT

CCTTCCAGTACTCTTCGAGGGGAACCCGTCCTGATCTGCACGGTAAGAGCCTAGCATGTAGAACTGGTTG

ACGGCCTTGTAGGCGCAGCAGCCCTTCTCCACGGGAGGGCGTAGGCCTGGGCGGCCTTGCGCAGGGAGG

TGTGCGTGAGGGCGAAAGTGTCCCTGACCATGACCTTGAGGAACTGGTGCTTGAAGTCGATATCGTCGCAG

CCCCCCTGCTCCCAGAGCTGGAAGTCCGTGCGCTTCTTGTAGGCGGGGTTGGGCAAAGCGAAAGTAACATC

GTTGAAGAGGATCTTGCCCGCGCGGGGCATAAAGTTGCGAGTGATGCGGAAAGGTTGGGGCACCTCGGCC

CGGTTGTTGATGACCTGGGCGGCGAGCACGATCTCGTCGAAGCCGTTGATGTTGTGCCCACGATGTAGAG

TTCCACGAATCGCGGACGGCCCTTGACGTGGGGCAGTTTCTTGAGCTCCTCGTAGGTGAGCTCGTCGGGGTC

GCTGAGCCCGTGCTGCTCGAGCGCCCAGTCGGCGAGATGGGGGTTGGCGCGGAGGAAGGAAGTCCAGAGA

TCCACGCCAGGGCGGTTTGCAGACGGTCCCGGTACTGACGGAACTGCTGCCCGACGGCCATTTTTTCGGG

GGTGACGCAGTAGAAGGTGCGGGGGTCCCCGTGCCAGCGATCCCATTTGAGCTGGAGGGCGAGATCGAGG

-continued

```
GCGAGCTCGACGAGCCGGTCGTCCCCGGAGAGTTTCATGACCAGCATGAAGGGGACGAGCTGCTTGCCGA

AGGACCCCATCCAGGTGTAGGTTTCCACATCGTAGGTGAGGAAGAGCCTTTCGGTGCGAGGATGCGAGCCG

ATGGGGAAGAACTGGATCTCCTGCCACCAATTGGAGGAATGGCTGTTGATGTGATGGAAGTAGAAATGCCG

ACGGCGCGCCGAACACTCGTGCTTGTGTTTATACAAGCGGCCACAGTGCTCGCAACGCTGCACGGGATGCA

CGTGCTGCACGAGCTGTACCTGAGTTCCTTTGACGAGGAATTTCAGTGGGAAGTGGAGTCGTGGCGCCTGC

ATCTCGTGCTGTACTACGTCGTGGTGGTCGGCCTGGCCCTCTTCTGCCTCGATGGTGGTCATGCTGACGAGC

CCGCGCGGGAGGCAGGTCCAGACCTCGGCGCGAGCGGGTCGGAGAGCGAGGACGAGGGCGCGCAGGCCG

GAGCTGTCCAGGGTCCTGAGACGCTGCGGAGTCAGGTCAGTGGGCAGCGGCGGCGCGCGGTTGACTTGCA

GGAGTTTTTCCAGGGCGCGCGGGAGGTCCAGATGGTACTTGATCTCCACCGCGCCATTGGTGGCGACGTCG

ATGGCTTGCAGGGTCCCGTGCCCCTGGGGTGTGACCACCGTCCCCCGTTTCTTCTTGGGCGGCTGGGGCGAC

GGGGGCGGTGCCTCTTCCATGGTTAGAAGCGGCGGCGAGGACGCGCGCCGGGCGGCAGGGGCGGCTCGGG

GCCCGGAGGCAGGGGCGGCAGGGGCACGTCGGCGCCGCGCGGGTAGGTTCTGGTACTGCGCCCGGAGA

AGACTGGCGTGAGCGACGACGCGACGGTTGACGTCCTGGATCTGACGCCTCTGGGTGAAGGCCACGGGAC

CCGTGAGTTTGAACCTGAAAGAGAGTTCGACAGAATCAATCTCGGTATCGTTGACGGCGGCCTGCCGCAGG

ATCTCTTGCACGTCGCCCGAGTTGTCCTGGTAGGCGATCTCGGTCATGAACTGCTCGATCTCCTCCTCTTGA

AGGTCTCCGCGGCCGGCGCGCTCCACGGTGGCCGCGAGGTCGTTGGAGATGCGGCCCATGAGCTGCGAGA

AGGCGTTCATGCCCGCCTCGTTCCAGACGCGGCTGTAGACCACGACGCCCTCGGGATCGCGGGCGCGCATG

ACCACCTGGGCGAGGTTGAGCTCCACGTGGCGCGTGAAGACCGCGTAGTTGCAGAGGCGCTGGTAGAGGT

AGTTGAGCGTGGTGGCGATGTGCTCGGTGACGAAGAAATACATGATCCAGCGGCGGAGCGGCATCTCGCTG

ACGTCGCCCAGCGCCTCCAAACGTTCCATGGCCTCGTAAAAGTCCACGGCGAAGTTGAAAAACTGGGAGTT

GCGCGCCGAGACGGTCAACTCCTCCTCCAGAAGACGGATGAGCTCGGCGATGGTGGCGCGCACCTCGCGCT

CGAAGGCCCCCGGGAGTTCCTCCACTTCCTCTTCTTCCTCCTCCACTAACATCTCTTCTACTTCCTCCTCAGG

CGGCAGTGGTGGCGGGGAGGGGGCCTGCGTCGCCGGCGGCGCACGGGCAGACGGTCGATGAAGCGCTCG

ATGGTCTCGCCGCGCCGGCGTCGCATGGTCTCGGTGACGGCGCGCCCGTCCTCGCGGGGCCGCAGCGTGAA

GACGCCGCCGCGCATCTCCAGGTGGCCGGGGGGGTCCCCGTTGGGCAGGGAGAGGGCGCTGACGATGCAT

CTTATCAATTGCCCCGTAGGGACTCCGCGCAAGGACCTGAGCGTCTCGAGATCCACGGGATCTGAAAACCG

CTGAACGAAGGCTTCGAGCCAGTCGCAGTCGCAAGGTAGGCTGAGCACGGTTTCTTCTGGCGGGTCATGTT

GGTTGGGAGCGGGGCGGGCGATGCTGCTGGTGATGAAGTTGAAATAGGCGGTTCTGAGACGGCGGATGGT

GGCGAGGAGCACCAGGTCTTTGGGCCCGGCTTGCTGGATGCGCAGACGGTCGGCCATGCCCCAGGCGTGGT

CCTGACACCTGGCCAGGTCCTTGTAGTAGTCCTGCATGAGCCGCTCCACGGGCACCTCCTCCTCGCCCGCGC

GGCCGTGCATGCGCGTGAGCCCGAAGCCGCGCTGGGGCTGGACGAGCGCAGGTCGGCGACGACGCGCTC

GGCGAGGATGGCTTGCTGGATCTGGGTGAGGGTGGTCTGGAAGTCATCAAAGTCGACGAAGCGGTGGTAG

GCTCCGGTGTTGATGGTGTAGGAGCAGTTGGCCATGACGACCAGTTGACGGTCTGGTGGCCCGGACGCAC

GAGCTCGTGGTACTTGAGGCGCGAGTAGGCGCGCGTGTCGAAGATGTAGTCGTTGCAGGTGCGCACCAGGT

ACTGGTAGCCGATGAGGAAGTGCGGCGGCGGCTGGCGGTAGAGCGGCCATCGCTCGGTGGCGGGGCGCC

GGGCGCGAGGTCCTCGAGCATGGTGCGGTGGTAGCCGTAGATGTACCTGGACATCCAGGTGATGCCGGCGG

CGGTGGTGGAGGCGCGCGGGAACTCGCGGACGCGGTTCCAGATGTTGCGCAGCGGCAGGAAGTAGTTCAT

GGTGGGCACGGTCTGGCCCGTGAGGCGCGCGCAGTCGTGGATGCTCTATACGGGCAAAAACGAAGCGGT

CAGCGGCTCGACTCCGTGGCCTGGAGGCTAAGCGAACGGGTTGGGCTGCGCGTGTACCCCGGTTCGAATCT

CGAATCAGGCTGGAGCCGCAGCTAACGTGGTATTGGCACTCCCGTCTCGACCCAAGCCTGCACCAACCCTC
```

-continued

```
CAGGATACGGAGGCGGGTCGTTTTGCAACTTTTTTTTGGAGGCCGGATGAGACTAGTAAGCGCGGAAAGCG
GCCGACCGCGATGGCTCGCTGCCGTAGTCTGGAGAAGAATCGCCAGGGTTGCGTTGCGGTGTGCCCCGGTT
CGAGGCCGGCCGGATTCCGCGGCTAACGAGGGCGTGGCTGCCCCGTCGTTTCCAAGACCCCATAGCCAGCC
GACTTCTCCAGTTACGGAGCGAGCCCTCTTTTGTTTGTTTGTTTTTGCCAGATGCATCCCGTACTGCGGCA
GATGCGCCCCCACCACCCTCCACCGCAACAACAGCCCCCTCCACAGCCGGCGCTTCTGCCCCCGCCCCAGC
AGCAACTTCCAGCCACGACCGCCGCGCCGCCGTGAGCGGGGCTGGACAGAGTTATGATCACCAGCTGGC
CTTGGAAGAGGGCGAGGGGCTGGCGCGCCTGGGGCGTCGTCGCCGGAGCGGCACCCGCGCGTGCAGATG
AAAAGGGACGCTCGCGAGGCCTACGTGCCCAAGCAGAACCTGTTCAGAGACAGGAGCGGCGAGGAGCCCG
AGGAGATGCGCGCGGCCCGGTTCCACGCGGGGCGGGAGCTGCGGCGCGGCCTGGACCGAAAGAGGGTGCT
GAGGGACGAGGATTTCGAGGCGGACGAGCTGACGGGGATCAGCCCCGCGCGCGCACGTGGCCGCGGCC
AACCTGGTCACGGCGTACGAGCAGACCGTGAAGGAGGAGAGCAACTTCCAAAATCCTTCAACAACCACG
TGCGCACCCTGATCGCGCGCGAGGAGGTGACCCTGGGCCTGATGCACCTGTGGGACCTGCTGGAGGCCATC
GTGCAGAACCCCACCAGCAAGCCGCTGACGGCGCAGCTGTTCCTGGTGGTGCAGCATAGTCGGGACAACG
AAGCGTTCAGGGAGGCGCTGCTGAATATCACCGAGCCCGAGGGCCGCTGGCTCCTGGACCTGGTGAACATT
CTGCAGAGCATCGTGGTGCAGGAGCGCGGGCTGCCGCTGTCCGAGAAGCTGGCGGCCATCAACTTCTCGGT
GCTGAGTTTGGGCAAGTACTACGCTAGGAAGATCTACAAGACCCCGTACGTGCCCATAGACAAGGAGGTG
AAGATCGACGGGTTTTACATGCGCATGACCCTGAAAGTGCTGACCCTGAGCGACGATCTGGGGGTGTACCG
CAACGACAGGATGCACCGTGCGGTGAGCGCCAGCAGGCGGCGCGAGCTGAGCGACCAGGAGCTGATGCAT
AGTCTGCAGCGGGCCCTGACCGGGGCCGGGACCGAGGGGGAGAGCTACTTTGACATGGGCGCGGACCTGC
ACTGGCAGCCCAGCCGCCGGGCCTTGGAGGCGGCGGCAGGACCCTACGTGAAGAGGTGGACGATGAGGT
GGACGAGGAGGGCGAGTACCTGGAAGACTGATGGCGCGACCGTATTTTGCTAGATGCAACAACAACAGC
CACCTCCTGATCCCGCGATGCGGGCGGCGCTGCAGAGCCAGCCGTCCGGCATTAACTCCTCGGACGATTGG
ACCCAGGCCATGCAACGCATCATGGCGCTGACGACCCGCAACCCCGAAGCCTTTAGACAGCAGCCCCAGG
CCAACCGGCTCTCGGCCATCCTGGAGGCCGTGGTGCCCTCGCGCTCCAACCCCACGCACGAGAAGGTCCTG
GCCATCGTGAACGCGCTGGTGGAGAACAAGGCCATCCGCGGCGACGAGGCCGGCCTGGTGTACAACGCGC
TGCTGGAGCGCGTGGCCCGCTACAACAGCACCAACGTGCAGACCAACCTGGACCGCATGGTGACCGACGT
GCGCGAGGCCGTGGCCCAGCGCGAGCGGTTCCACCGCGAGTCCAACCTGGGATCCATGGTGGCGCTGAAC
GCCTTCCTCAGCACCCAGCCCGCCAACGTGCCCCGGGGCCAGGAGGACTACACCAACTTCATCAGCGCCCT
GCGCCTGATGGTGACCGAGGTGCCCCAGAGCGAGGTGTACCAGTCCGGGCCGGACTACTTCTTCCAGACCA
GTCGCCAGGGCTTGCAGACCGTGAACCTGAGCCAGGCTTCAAGAACTTGCAGGGCCTGTGGGCGTGCAG
GCCCCGGTCGGGACCGCGCGACGGTGTCGAGCCTGCTGACGCCGAACTCGCGCCTGCTGCTGCTGCTGGT
GGCCCCCTTCACGGACAGCGGCAGCATCAACCGCAACTCGTACCTGGGCTACCTGATTAACCTGTACCGCG
AGGCCATCGGCCAGGCGCACGTGGACGAGCAGACCTACCAGGAGATCACCCACGTGAGCCGCGCCCTGGG
CCAGGACGACCCGGGCAACCTGGAAGCCACCCTGAACTTTTTGCTGACCAACCGGTCGCAGAAGATCCCGA
CCCAGTACGCGCTCAGCACCGAGGAGGAGCGCATCCTGCGTTACGTGCAGCAGAGCGTGGGCCTGTTCCTG
ATGCAGGAGGGGCCACCCCCAGCGCCGCGCTCGACATGACCGCGCGCAACATGGAGCCCAGCATGTACG
CCAGCAACCGCCCGTTCATCAATAACTGATGGACTACTTGCATCGGGCGGCCGCCATGAACTCTGACTAT
TTCACCAACGCCATCCTGAATCCCCACTGGCTCCCGCCGCCGGGGTTCTACACGGGCGAGTACGACATGCC
CGACCCCAATGACGGGTTCCTGTGGGACGATGTGGACAGCAGCGTGTTCTCCCCCCGACCGGGTGCTAACG
AGCGCCCCTTGTGGAAGAAGGAAGGCAGCGACCGACGCCCGTCCTCGGCGCTGTCCGGCCGCGAGGGTGC
TGCCGCGGCGGTGCCCGAGGCCGCCAGTCCTTTCCCGAGCTTGCCCTTCTCGCTGAACAGTATCCGCAGCA
```

-continued

```
GCGAGCTGGGCAGGATCACGCGCCCGCGCTTGCTGGGCGAAGAGGAGTACTTGAATGACTCGCTGTTGAGA

CCCGAGCGGGAGAAGAACTTCCCCAATAACGGGATAGAAAGCCTGGTGGACAAGATGAGCCGCTGGAAGA

CGTATGCGCAGGAGCACAGGGACGATCCCCGGGCGTCGCAGGGGGCCACGAGCCGGGGCAGCGCCGCCCG

TAAACGCCGGTGGCACGACAGGCAGCGGGGACAGATGTGGGACGATGAGGACTCCGCCGACGACAGCAGC

GTGTTGGACTTGGGTGGGAGTGGTAACCCGTTCGCTCACCTGCGCCCCGTATCGGGCGCATGATGTAAGA

GAAACCGAAATAAATGATACTCACCAAGGCCATGGCGACCAGCGTGCGTTCGTTTCTTCTCTGTTGTTGTT

GTATCTAGTATGATGAGGCGTGCGTACCCGGAGGGTCCTCCTCCCTCGTACGAGAGCGTGATGCAGCAGGC

GATGGCGGCGGCGGCGATGCAGCCCCCGCTGGAGGCTCCTTACGTGCCCCCGCGGTACCTGGCGCCTACGG

AGGGGCGGAACAGCATTCGTTACTCGGAGCTGGCACCCTTGTACGATACCACCCGGTTGTACCTGGTGGAC

AACAAGTCGGCGGACATCGCCTCGCTGAACTACCAGAACGACCACAGCAACTTCCTGACCACCGTGGTGCA

GAACAATGACTTCACCCCCACGGAGGCCAGCACCCAGACCATCAACTTTGACGAGCGCTCGCGGTGGGGC

GGCCAGCTGAAAACCATCATGCACACCAACATGCCCAACGTGAACGAGTTCATGTACAGCAACAAGTTCA

AGGCGCGGGTGATGGTCTCCCGCAAGACCCCCAATGGGGTGACAGTGACAGAGGATTATGATGGTAGTCA

GGATGAGCTGAAGTATGAATGGGTGGAATTTGAGCTGCCCGAAGGCAACTTCTCGGTGACCATGACCATCG

ACCTGATGAACAACGCCATCATCGACAATTACTTGGCGGTGGGGCGGCAGAACGGGGTGCTGGAGAGCGA

CATCGGCGTGAAGTTCGACACTAGGAACTTCAGGCTGGGCTGGGACCCCGTGACCGAGCTGGTCATGCCCG

GGGTGTACACCAACGAGGCTTTCCATCCCGATATTGTCTTGCTGCCCGGCTGCGGGGTGGACTTCACCGAG

AGCCGCCTCAGCAACCTGCTGGGCATTCGCAAGAGGCAGCCCTTCCAGGAAGGCTTCCAGATCATGTACGA

GGATCTGGAGGGGGGCAACATCCCCGCGCTCCTGGATGTCGACGCCTATGAGAAAAGCAAGGAGGATGCA

GCAGCTGAAGCAACTGCAGCCGTAGCTACCGCCTCTACCGAGGTCAGGGGCGATAATTTTGCAAGCGCCGC

AGCAGTGGCAGCGGCCGAGGCGGCTGAAACCGAAAGTAAGATAGTCATTCAGCCGGTGGAGAAGGATAGC

AAGAACAGGAGCTACAACGTACTACCGGACAAGATAAACACCGCCTACCGCAGCTGGTACCTAGCCTACA

ACTATGGCGACCCCGAGAAGGGCGTGCGCTCCTGGACGCTGCTCACCACCTCGGACGTCACCTGCGGCGTG

GAGCAAGTCTACTGGTCGCTGCCCGACATGATGCAAGACCCGGTCACCTTCCGCTCCACGCGTCAAGTTAG

CAACTACCCGGTGGTGGGCGCCGAGCTCCTGCCCGTCTACTCCAAGAGCTTCTTCAACGAGCAGGCCGTCT

ACTCGCAGCAGCTGCGCGCCTTCACCTCGCTTACGCACGTCTTCAACCGCTTCCCCGAGAACCAGATCCTCG

TCCGCCCGCCCGCGCCCACCATTACCACCGTCAGTGAAAACGTTCCTGCTCTCACAGATCACGGGACCCTG

CCGCTGCGCGCAGTATCCGGGGAGTCCAGCGCGTGACCGTTACTGCGCCAGACGCCGCACCTGCCCCTA

CGTCTACAAGGCCCTGGGCATAGTCGCGCCGCGCGTCCTCTCGAGCCGCACCTTCTAAATGTCCATTCTCAT

CTCGCCCAGTAATAACACCGGTTGGGGCCTGCGCGCGCCCAGCAAGATGTACGGAGGCGCTCGCCAACGCT

CCACGCAACACCCCGTGCGCGTGCGCGGGCACTTCCGCGCTCCCTGGGGCGCCCTCAAGGGCCGCGTGCGG

TCGCGCACCACCGTCGACGACGTGATCGACCAGGTGGTGGCCGACGCGCGCAACTACACCCCCGCCGCCGC

GCCCGTCTCCACCGTGGACGCCGTCATCGACAGCGTGGTGGCCGACGCGCGCCGGTACGCCCGCGCCAAGA

GCCGGCGGCGGCGCATCGCCCGGCGGCACCGGAGCACCCCCGCCATGCGCGCGGCGCGAGCCTTGCTGCG

CAGGGCCAGGCGCACGGGACGCAGGGCCATGCTCAGGGCGGCCAGACGCGCGGCTTCAGGCGCCAGCGCC

GGCAGGACCCGGAGACGCGCGGCCACGGCGGCGGCAGCGGCCATCGCCAGCATGTCCCGCCCGCGGCGAG

GGAACGTGTACTGGGTGCGCGACGCCGCCACCGGTGTGCGCGTGCCCGTGCGCACCCGCCCCCCTCGCACT

TGAAGATGTTCACTTCGCGATGTTGATGTGTCCCAGCGGCGAGGAGGATGTCCAAGCGCAAATTCAAGGAA

GAGATGCTCCAGGTCATCGCGCCTGAGATCTACGGCCCTGCGGTGGTGAAGGAGGAAAGAAAGCCCCGCA

AAATCAAGCGGGTCAAAAAGGACAAAAAGGAAGAAGAAAGTGATGTGGACGGATTGGTGGAGTTTGTGCG
```

-continued

CGAGTTCGCCCCCCGGCGGCGCGTGCAGTGGCGCGGGCGGAAGGTGCAACCGGTGCTGAGACCCGGCACC

ACCGTGGTCTTCACGCCCGGCGAGCGCTCCGGCACCGCTTCCAAGCGCTCCTACGACGAGGTGTACGGGGA

TGATGATATTCTGGAGCAGGCGGCCGAGCGCCTGGGCGAGTTTGCTTACGGCAAGCGCAGCCGTTCCGCAC

CGAAGGAAGAGGCGGTGTCCATCCCGCTGGACCACGGCAACCCCACGCCGAGCCTCAAGCCCGTGACCTT

GCAGCAGGTGCTGCCGACCGCGGCGCCGCGCCGGGGGTTCAAGCGCGAGGGCGAGCATCTGTACCCCACC

ATGCAGCTGATGGTGCCCAAGCGCCAGAAGCTGGAAGACGTGCTGGAGACCATGAAGGTGGACCGGACG

TGCAGCCCGAGGTCAAGGTGCGGCCCATCAAGCAGGTGGCCCCGGGCCTGGGCGTGCAGACCGTGGACAT

CAAGATTCCCACGGAGCCCATGGAAACGCAGACCGAGCCCATGATCAAGCCCAGCACCAGCACCATGGAG

GTGCAGACGGATCCCTGGATGCCATCGGCTCCTAGTCGAAGACCCCGGCGCAAGTACGGCGCGGCCAGCCT

GCTGATGCCCAACTACGCGCTGCATCCTTCCATCATCCCCACGCCGGGCTACCGCGGCACGCGCTTCTACCG

CGGTCATACCAGCAGCCGCCGCCGCAAGACCACCACTCGCCGCCGCCGTCGCCGCACCGCCGCTGCAACCA

CCCCTGCCGCCCTGGTGCGGAGAGTGTACCGCCGCGGCCGCGCACCTCTGACCCTGCCGCGCGCGCGCTAC

CACCCGAGCATCGCCATTTAAACTTTCGCCTGCTTTGCAGATCAATGGCCCTCACATGCCGCCTTCGCGTTC

CCATTACGGGCTACCGAGGAAGAAAACCGCGCCGTAGAAGGCTGGCGGGGAACGGGATGCGTCGCCACCA

CCACCGGCGGCGGCGCGCCATCAGCAAGCGGTTGGGGGAGGCTTCCTGCCCGCGCTGATCCCCATCATCG

CCGCGGCGATCGGGGCGATCCCCGGCATTGCTTCCGTGGCGGTGCAGGCCTCTCAGCGCCACTGAGACACA

CTTGGAAACATCTTGTAATAAACCAATGGACTCTGACGCTCCTGGTCCTGTGATGTGTTTTCGTAGACAGAT

GGAAGACATCAATTTTTCGTCCCTGGCTCCGCGACACGGCACGCGGCCGTTCATGGGCACCTGGAGCGACA

TCGGCACCAGCCAACTGAACGGGGGCGCCTTCAATTGGAGCAGTCTCTGGAGCGGGCTTAAGAATTTCGGG

TCCACGCTTAAAACCTATGGCAGCAAGGCGTGGAACAGCACCACAGGGCAGGCGCTGAGGGATAAGCTGA

AAGAGCAGAACTTCCAGCAGAAGGTGGTCGATGGGCTCGCCTCGGGCATCAACGGGGTGGTGGACCTGGC

CAACCAGGCCGTGCAGCGGCAGATCAACAGCCGCCTGGACCCGGTGCCGCCCGCCGGCTCCGTGGAGATG

CCGCAGGTGGAGGAGGAGCTGCCTCCCCTGGACAAGCGGGGCGAGAAGCGACCCCGCCCCGATGCGGAGG

AGACGCTGCTGACGCACACGGACGAGCCGCCCCCGTACGAGGAGGCGGTGAAACTGGGTCTGCCCACCAC

GCGGCCCATCGCGCCCCTGGCCACCGGGGTGCTGAAACCCGAAAAGCCCGCGACCCTGGACTTGCCTCCTC

CCCAGCCTTCCCGCCCCTCTACAGTGGCTAAGCCCCTGCCGCCGGTGGCCGTGGCCCGCGCGCGACCCGGG

GGCACCGCCCGCCCTCATGCGAACTGGCAGAGCACTCTGAACAGCATCGTGGGTCTGGGAGTGCAGAGTGT

GAAGCGCCGCCGCTGCTATTAAACCTACCGTAGCGCTTAACTTGCTTGTCTGTGTGTATGTATTATGTCG

CCGCCGCCGCTGTCCACCAGAAGGAGGAGTGAAGAGGCGCGTCGCCGAGTTGCAAGATGGCCACCCCATC

GATGCTGCCCCAGTGGGCGTACATGCACATCGCCGGACAGGACGCTTCGGAGTACCTGAGTCCGGGTCTGG

TGCAGTTTGCCCGCGCCACAGACACCTACTTCAGTCTGGGGAACAAGTTTAGGAACCCCACGGTGGCGCCC

ACGCACGATGTGACCACCGACCGCAGCCAGCGGCTGACGCTGCGCTTCGTGCCCGTGGACCGCGAGGACA

ACACCTACTCGTACAAAGTGCGCTACACGCTGGCCGTGGGCGACAACCGCGTGCTGGACATGGCCAGCACC

TACTTTGACATCCGCGGCGTGCTGGATCGGGGCCCTAGCTTCAAACCCTACTCCGGCACCGCCTACAACAG

TCTGGCCCCCAAGGGAGCACCCAACACTTGTCAGTGGACATATAAAGCCGATGGTGAAACTGCCACAGAA

AAAACCTATACATATGGAAATGCACCCGTGCAGGGCATTAACATCACAAAAGATGGTATTCAACTTGGAAC

TGACACCGATGATCAGCCAATCTACGCAGATAAAACCTATCAGCCTGAACCTCAAGTGGGTGATGCTGAAT

GGCATGACATCACTGGTACTGATGAAAAGTATGGAGGCAGAGCTCTTAAGCCTGATACCAAAATGAAGCCT

TGTTATGGTTCTTTTGCCAAGCCTACTAATAAAGAAGGAGGTCAGGCAAATGTGAAAACAGGAACAGGCAC

TACTAAAGAATATGACATAGACATGGCTTTCTTTGACAACAGAAGTGCGGCTGCTGCTGGCCTAGCTCCAG

AAATTGTTTTGTATACTGAAAATGTGGATTTGGAAACTCCAGATACCCATATTGTATACAAAGCAGGCACA

-continued

```
GATGACAGCAGCTCTTCTATTAATTTGGGTCAGCAAGCCATGCCCAACAGACCTAACTACATTGGTTTCAGA
GACAACTTTATCGGGCTCATGTACTACAACAGCACTGGCAATATGGGGGTGCTGGCCGGTCAGGCTTCTA
GCTGAATGCTGTGGTTGACTTGCAAGACAGAAACACCGAGCTGTCCTACCAGCTCTTGCTTGACTCTCTGGG
TGACAGAACCCGGTATTTCAGTATGTGGAATCAGGCGGTGGACAGCTATGATCCTGATGTGCGCATTATTG
AAAATCATGGTGTGGAGGATGAACTTCCCAACTATTGTTTCCCTCTGGATGCTGTTGGCAGAACAGATACTT
ATCAGGGAATTAAGGCTAATGGAACTGATCAAACCACATGGACCAAAGATGACAGTGTCAATGATGCTAA
TGAGATAGGCAAGGGTAATCCATTCGCCATGGAAATCAACATCCAAGCCAACCTGTGGAGGAACTTCCTCT
ACGCCAACGTGGCCCTGTACCTGCCCGACTCTTACAAGTACACGCCGGCCAATGTTACCCTGCCCACCAAC
ACCAACACCTACGATTACATGAACGGCCGGGTGGTGGCGCCCTCGCTGGTGGACTCCTACATCAACATCGG
GGCGCGCTGGTCGCTGGATCCCATGGACAACGTGAACCCTTCAACCACCACCGCAATGCGGGCTGCGCT
ACCGCTCCATGCTCCTGGGCAACGGGCGCTACGTGCCCTTCCACATCCAGGTGCCCCAGAAATTTTTCGCCA
TCAAGAGCCTCCTGCTCCTGCCCGGGTCCTACACCTACGAGTGGAACTTCCGCAAGGACGTCAACATGATC
CTGCAGAGCTCCCTCGGCAACGACCTGCGCACGGACGGGGCCTCCATCTCCTTCACCAGCATCAACCTCTA
CGCCACCTTCTTCCCCATGGCGCACAACACGGCCTCCACGCTCGAGGCCATGCTGCGCAACGACACCAACG
ACCAGTCCTTCAACGACTACCTCTCGGCGGCCAACATGCTCTACCCCATCCCGGCCAACGCCACCAACGTG
CCCATCTCCATCCCCTCGCGCAACTGGGCCGCCTTCCGCGGCTGGTCCTTCACGCGTCTCAAGACCAAGGAG
ACGCCCTCGCTGGGCTCCGGGTTCGACCCCTACTTCGTCTACTCGGGCTCCATCCCTACCTCGACGGCACC
TTCTACCTCAACCACACCTTCAAGAAGGTCTCCATCACCTTCGACTCCTCCGTCAGCTGGCCCGGCAACGAC
CGGCTCCTGACGCCCAACGAGTTCGAAATCAAGCGCACCGTCGACGGCGAGGGCTACAACGTGGCCCAGT
GCAACATGACCAAGGACTGGTTCCTGGTCCAGATGCTGGCCCACTACAACATCGGCTACCAGGGCTTCTAC
GTGCCCGAGGGCTACAAGGACCGCATGTACTCCTTCTTCCGCAACTTCCAGCCCATGAGCCGCCAGGTGGT
GGACGAGGTCAACTACAAGGACTACCAGGCCGTCACCCTGGCCTACCAGCACAACAACTCGGGCTTCGTCG
GCTACCTCGCGCCCACCATGCGCCAGGGCCAGCCCTACCCCGCCAACTACCCCTACCCGCTCATCGGCAAG
AGCGCCGTCACCAGCGTCACCCAGAAAAAGTTCCTCTGCGACAGGTCATGTGGCGCATCCCCTTCTCCAG
CAACTTCATGTCCATGGGCGCGCTCACCGACCTCGGCCAGAACATGCTCTATGCCAACTCCGCCCACGCGC
TAGACATGAATTTCGAAGTCGACCCCATGGATGAGTCCACCCTTCTCTATGTTGTCTTCGAAGTCTTCGACG
TCGTCCGAGTGCACCAGCCCCACCGCGGCGTCATCGAGGCCGTCTACCTGCGCACCCCCTTCTCGGCCGGT
AACGCCACCACCTAAGCTCTTGCTTCTTGCAAGCCATGGCCGCGGGCTCCGGCGAGCAGGAGCTCAGGGCC
ATCATCCGCGACCTGGGCTGCGGGCCCTACTTCCTGGGCACCTTCGATAAGCGCTTCCCGGGATTCATGGCC
CCGCACAAGCTGGCCTGCGCCATCGTCAACACGGCCGGCCGCGAGACCGGGGGCGAGCACTGGCTGGCCT
TCGCCTGGAACCCGCGCTCGAACACCTGCTACCTCTTCGACCCTTCGGGTTCTCGGACGAGCGCCTCAAGC
AGATCTACCAGTTCGAGTACGAGGGCCTGCTGCGCCGCAGCGCCCTGGCCACCGAGGACCGCTGCGTCACC
CTGGAAAAGTCCACCCAGACCGTGCAGGGTCCGCGCTCGGCCGCCTGCGGGCTCTTCTGCTGCATGTTCCT
GCACGCCTTCGTGCACTGGCCCGACCGCCCCATGGACAAGAACCCCACCATGAACTTGCTGACGGGGTGC
CCAACGGCATGCTCCAGTCGCCCCAGGTGGAACCCACCCTGCGCCGCAACCAGGAGGCGCTCTACCGCTTC
CTCAACTCCCACTCCGCCTACTTTCGCTCCCACCGCGCGCGCATCGAGAAGGCCACCGCCTTCGACCGCATG
AATCAAGACATGTAAACCGTGTGTATGTTAAATGTCTTTAATAAACAGCACTTTCATGTTACACATGCAT
CTGAGATGATTTATTTAGAAATCGAAAGGGTTCTGCCGGGTCTCGGCATGCCCGCGGGCAGGGACACGTT
GCGGAACTGGTACTTGGCCAGCCACTTGAACTCGGGGATCAGCAGTTTGGGCAGCGGGGTGTCGGGGAAG
GAGTCGGTCCACAGCTTCCGCGTCAGTTGCAGGGCGCCCAGCAGGTCGGGCGCGGAGATCTTGAAATCGCA
```

-continued

GTTGGGACCCGCGTTCTGCGCGCGGGAGTTGCGGTACACGGGGTTGCAGCACTGGAACACCATCAGGGCCG

GGTGCTTCACGCTCGCCAGCACCGTCGCGTCGGTGATGCTCTCCACGTCGAGGTCCTCGGCGTTGGCCATCC

CGAAGGGGGTCATCTTGCAGGTCTGCCTTCCCATGGTGGGCACGCACCCGGGCTTGTGGTTGCAATCGCAG

TGCAGGGGATCAGCATCATCTGGGCCTGGTCGGCGTTCATCCCCGGGTACATGGCCTTCATGAAAGCCTC

CAATTGCCTGAACGCCTGCTGGGCCTTGGCTCCCTCGGTGAAGAAGACCCCGCAGGACTTGCTAGAGAACT

GGTTGGTGGCGCACCCGGCGTCGTGCACGCAGCAGCGCGCGTCGTTGTTGGCCAGCTGCACCACGCTGCGC

CCCCAGCGGTTCTGGGTGATCTTGGCCCGGTCGGGGTTCTCCTTCAGCGCGCGCTGCCCGTTCTCGCTCGCC

ACATCCATCTCGATCATGTGCTCCTTCTGGATCATGGTGGTCCCGTGCAGGCACCGCAGCTTGCCCTCGGCC

TCGGTGCACCCGTGCAGCCACAGCGCGCACCCGGTGCACTCCCAGTTCTTGTGGGCGATCTGGGAAATGCGC

GTGCACGAAGCCCTGCAGGAAGCGGCCCATCATGGTGGTCAGGGTCTTGTTGCTAGTGAAGGTCAGCGGAA

TGCCGCGGTGCTCCTCGTTGATGTACAGGTGGCAGATGCGGCGGTACACCTCGCCCTGCTCGGGCATCAGC

TGGAAGTTGGCTTTCAGGTCGGTCTCCACGCGGTAGCGGTCCATCAGCATAGTCATGATTTCCATACCCTTC

TCCCAGGCCGAGACGATGGGCAGGCTCATAGGGTTCTTCACCATCATCTTAGCGCTAGCAGCCGCGGCCAG

GGGGTCGCTCTCGTCCAGGGTCTCAAAGCTCCGCTTGCCGTCCTTCTCGGTGATCCGCACCGGGGGGTAGCT

GAAGCCCACGGCCGCCAGCTCCTCCTCGGCCTGTCTTTCGTCCTCGCTGTCCTGGCTGACGTCCTGCAGGAC

CACATGCTTGGTCTTGCGGGGTTTCTTCTTGGGCGGCAGCGGCGGCGGAGATGTTGGAGATGGCGAGGGGG

AGCGCGAGTTCTCGCTCACCACTACTATCTCTTCCTCTTCTTGGTCCGAGGCCACGCGGCGGTAGGTATGTC

TCTTCGGGGGCAGAGGCGGAGGCGACGGGCTCTCGCCGCCGCGACTTGGCGGATGGCTGGCAGAGCCCCTT

CCGCGTTCGGGGGTGCGCTCCCGGCGGCGCTCTGACTGACTTCCTCCGCGGCCGGCCATTGTGTTCTCCTAG

GGAGGAACAACAAGCATGGAGACTCAGCCATCGCCAACCTCGCCATCTGCCCCCACCGCCGACGAGAAGC

AGCAGCAGCAGAATGAAAGCTTAACCGCCCCGCCGCCCAGCCCCGCCACCTCCGACGCGGCCGTCCCAGA

CATGCAAGAGATGGAGGAATCCATCGAGATTGACCTGGGCTATGTGACGCCCGCGGAGCACGAGGAGGAG

CTGGCAGTGCGCTTTTCACAAGAAGAGATACACCAAGAACAGCCAGAGCAGGAAGCAGAGAATGAGCAGA

GTCAGGCTGGGCTCGAGCATGACGGCGACTACCTCCACCTGAGCGGGGGGAGGACGCGCTCATCAAGCA

TCTGGCCCGGCAGGCCACCATCGTCAAGGATGCGCTGCTCGACCGCACCGAGGTGCCCCTCAGCGTGGAGG

AGCTCAGCCGCGCCTACGAGTTGAACCTCTTCTCGCCGCGCGTGCCCCCCAAGCGCCAGCCCAATGGCACC

TGCGAGCCCAACCCGCGCCTCAACTTCTACCCGGTCTTCGCGGTGCCCGAGGCCCTGGCCACCTACCACATC

TTTTTCAAGAACCAAAAGATCCCCGTCTCCTGCCGCGCCAACCGCACCCGCGCCGACGCCCTTTTCAACCTG

GGTCCCGGCGCCCGCCTACCTGATATCGCCTCCTTGGAAGAGGTTCCCAAGATCTTCGAGGGTCTGGGCAG

CGACGAGACTCGGGCCGCGAACGCTCTGCAAGGAGAAGGAGGAGAGCATGAGCACCACAGCGCCCTGGTC

GAGTTGGAAGGCGACAACGCGCGGCTGGCGGTGCTCAAACGCACGGTCGAGCTGACCCATTTCGCCTACCC

GGCTCTGAACCTGCCCCCCAAAGTCATGAGCGCGGTCATGGACCAGGTGCTCATCAAGCGCGCGTCGCCCA

TCTCCGAGGACGAGGGCATGCAAGACTCCGAGGAGGGCAAGCCCGTGGTCAGCGACGAGCAGCTGGCCCG

GTGGCTGGGTCCTAATGCTAGTCCCCAGAGTTTGGAAGAGCGGCGCAAACTCATGATGGCCGTGGTCCTGG

TGACCGTGGAGCTGGAGTGCCTGCGCCGCTTCTTCGCCGACGCGGAGACCCTGCGCAAGGTCGAGGAGAAC

CTGCACTACCTCTTCAGGCACGGGTTCGTGCGCCAGGCCTGCAAGATCTCCAACGTGGAGCTGACCAACCT

GGTCTCCTACATGGGCATCTTGCACGAGAACCGCCTGGGGCAGAACGTGCTGCACACCACCTGCGCGGGG

AGGCCCGGCGCGACTACATCCGCGACTGCGTCTACCTCTACCTCTGCCACACCTGGCAGACGGGCATGGGC

GTGTGGCAGCAGTGTCTGGAGGAGCAGAACCTGAAAGAGCTCTGCAAGCTCCTGCAGAAGAACCTCAAGG

GTCTGTGGACCGGGTTCGACGAGCGCACCACCGCCTCGGACCTGGCCGACCTCATTTTCCCCGAGCGCCTC

AGGCTGACGCTGCGCAACGGCCTGCCCGACTTTATGAGCCAAAGCATGTTGCAAAACTTTCGCTCTTTCATC

-continued

```
CTCGAACGCTCCGGAATCCTGCCCGCCACCTGCTCCGCGCTGCCCTCGGACTTCGTGCCGCTGACCTTCCGC

GAGTGCCCCCGCCGCTGTGGAGCCACTGCTACCTGCTGCGCCTGGCCAACTACCTGGCCTACCACTCGGA

CGTGATCGAGGACGTCAGCGGCGAGGGCCTGCTCGAGTGCCACTGCCGCTGCAACCTCTGCACGCCGCACC

GCTCCCTGGCCTGCAACCCCCAGCTGCTGAGCGAGACCCAGATCATCGGCACCTTCGAGTTGCAAGGGCCC

AGCGAAGGCGAGGGTTCAGCCGCCAAGGGGGGTCTGAAACTCACCCCGGGGCTGTGGACCTCGGCCTACT

TGCGCAAGTTCGTGCCCGAGGACTACCATCCCTTCGAGATCAGGTTCTACGAGGACCAATCCCATCCGCCC

AAGGCCGAGCTGTCGGCCTGCGTCATCACCCAGGGGGCGATCCTGGCCCAATTGCAAGCCATCCAGAAATC

CCGCCAAGAATTCTTGCTGAAAAAGGGCCGCGGGGTCTACCTCGACCCCCAGACCGGTGAGGAGCTCAACC

CCGGCTTCCCCCAGGATGCCCCGAGGAAACAAGAAGCTGAAAGTGGAGCTGCCGCCCGTGGAGGATTTGG

AGGAAGACTGGGAGAACAGCAGTCAGGCAGAGGAGGAGGAGATGGAGGAAGACTGGGACAGCACTCAGG

CAGAGGAGGACAGCCTGCAAGACAGTCTGGAGGAAGACGAGGAGGAGGCAGAGGAGGAGGTGGAAGAAG

CAGCCGCCGCCAGACCGTCGTCCTCGGCGGGGAGAAAGCAAGCAGCACGGATACCATCTCCGCTCCGGG

TCGGGGTCCCGCTCGACCACACAGTAGATGGGACGAGACCGGACGATTCCCGAACCCCACCACCCAGACC

GGTAAGAAGGAGCGGCAGGGATACAAGTCCTGGCGGGGGCACAAAAACGCCATCGTCTCCTGCTTGCAGG

CCTGCGGGGCAACATCTCCTTCACCCGGCGCTACCTGCTCTTCCACCGCGGGGTGAACTTTCCCCGCAACA

TCTTGCATTACTACCGTCACCTCCACAGCCCCTACTACTTCCAAGAAGAGGCAGCAGCAGCAGAAAAAGAC

CAGCAGAAAACCAGCAGCTAGAAAATCCACAGCGGCGGCAGCAGGTGGACTGAGGATCGCGGCGAACGA

GCCGGCGCAAACCCGGGAGCTGAGGAACCGGATCTTTCCCACCCTCTATGCCATCTTCCAGCAGAGTCGGG

GGCAGGAGCAGGAACTGAAAGTCAAGAACCGTTCTCTGCGCTCGCTCACCCGCAGTTGTCTGTATCACAAG

AGCGAAGACCAACTTCAGCGCACTCTCGAGGACGCCCGAGGCTCTCTTCAACAAGTACTGCGCGCTCACTCT

TAAAGAGTAGCCCGCGCCCGCCCAGTCGCAGAAAAAGGCGGGAATTACGTCACCTGTGCCCTTCGCCCTAG

CCGCCTCCACCCATCATCATGAGCAAAGAGATTCCCACGCCTTACATGTGGAGCTACCAGCCCCAGATGGG

CCTGGCCGCCGGTGCCGCCCAGGACTACTCCACCCGCATGAATTGGCTCAGCGCCGGGCCCGCGATGATCT

CACGGGTGAATGACATCCGCGCCCACCGAAACCAGATACTCCTAGAACAGTCAGCGCTCACCGCCACGCCC

CGCAATCACCTCAATCCGCGTAATTGGCCCGCCGCCCTGGTGTACCAGGAAATTCCCCAGCCCACGACCGT

ACTACTTCCGCGAGACGCCCAGGCCGAAGTCCAGCTGACTAACTCAGGTGTCCAGCTGGCGGGCGGCGCCA

CCCTGTGTCGTCACCGCCCCGCTCAGGGTATAAAGCGGCTGGTGATCCGGGGCAGAGGCACACAGCTCAAC

GACGAGGTGGTGAGCTCTTCGCTGGGTCTGCGACCTGACGGAGTCTTCCAACTCGCCGGATCGGGGAGATC

TTCCTTCACGCCTCGTCAGGCCGTCCTGACTTTGGAGAGTTCGTCCTCGCAGCCCCGCTCGGGTGGCATCGG

CACTCTCCAGTTCGTGGAGGAGTTCACTCCCTCGGTCTACTTCAACCCCTTCTCCGGCTCCCCCGGCCACTA

CCCGGACGAGTTCATCCCGAACTTCGACGCCATCAGCGAGTCGGTGGACGGCTACGATTGAAACTAATCAC

CCCCTTATCCAGTGAAATAAAGATCATATTGATGATGATTTTACAGAAATAAAAAATAATCATTTGATTTGA

AATAAAGATACAATCATATTGATGATTTGAGTTTAACAAAAAAATAAAGAATCACTTACTTGAAATCTGAT

ACCAGGTCTCTGTCCATGTTTTCTGCCAACACCACTTCACTCCCCTCTTCCCAGCTCTGGTACTGCAGGCCCC

GGCGGGCTGCAAACTTCCTCCACACGCTGAAGGGGATGTCAAATTCCTCCTGTCCCTCAATCTTCATTTTAT

CTTCTATCAGATGTCCAAAAAGCGCGTCCGGGTGGATGATGACTTCGACCCCGTCTACCCCTACGATGCAG

ACAACGCACCGACCGTGCCCTTCATCAACCCCCCCTTCGTCTCTTCAGATGGATTCCAAGAGAAGCCCCTGG

GGGTGTTGTCCCTGCGACTGGCCGACCCCGTCACCACCAAGAACGGGGAAATCACCCTCAAGCTGGGAGA

GGGGGTGGACCTCGATTCCTCGGGAAAACTCATCTCCAACACGGCCACCAAGGCCGCCGCCCCTCTCAGTT

TTTCCAACAACACCATTTCCCTTAACATGGATCACCCCTTTTACACTAAAGATGGAAAATTATCCTTACAAG
```

-continued

```
TTTCTCCACCATTAAATATACTGAGAACAAGCATTCTAAACACACTAGCTTTAGGTTTTGGATCAGGTTTAG
GACTCCGTGGCTCTGCCTTGGCAGTACAGTTAGTCTCTCCACTTACATTTGATACTGATGGAAACATAAAGC
TTACCTTAGACAGAGGTTTGCATGTTACAACAGGAGATGCAATTGAAAGCAACATAAGCTGGGCTAAAGGT
TTAAAATTTGAAGATGGAGCCATAGCAACCAACATTGGAAATGGGTTAGAGTTTGGAAGCAGTAGTACAG
AAACAGGTGTTGATGATGCTTACCCAATCCAAGTTAAACTTGGATCTGGCCTTAGCTTTGACAGTACAGGA
GCCATAATGGCTGGTAACAAAGAAGACGATAAACTCACTTTGTGGACAACACCTGATCCATCACCAAACTG
TCAAATACTCGCAGAAAATGATGCAAAACTAACACTTTGCTTGACTAAATGTGGTAGTCAAATACTGGCCA
CTGTGTCAGTCTTAGTTGTAGGAAGTGGAAACCTAAACCCCATTACTGGCACCGTAAGCAGTGCTCAGGTG
TTTCTACGTTTTGATGCAAACGGTGTTCTTTTAACAGAACATTCTACACTAAAAAAATACTGGGGGTATAGG
CAGGGAGATAGCATAGATGGCACTCCATATACCAATGCTGTAGGATTCATGCCCAATTTAAAAGCTTATCC
AAAGTCACAAAGTTCTACTACTAAAAATAATATAGTAGGGCAAGTATACATGAATGGAGATGTTTCAAAAC
CTATGCTTCTCACTATAACCCTCAATGGTACTGATGACAGCAACAGTACATATTCAATGTCATTTTCATACA
CCTGGACTAATGGAAGCTATGTTGGAGCAACATTTGGGGCTAACTCTTATACCTTCTCATACATCGCCCAAG
AATGAACACTGTATCCCACCCTGCATGCCAACCCTTCCCACCCCACTCTGTGGAACAAACTCTGAAACACA
AAATAAAATAAAGTTCAAGTGTTTTATTGATTCAACAGTTTTACAGGATTCGAGCAGTTATTTTTCCTCCAC
CCTCCCAGGACATGGAATACACCACCCTCTCCCCCCGCACAGCCTTGAACATCTGAATGCCATTGGTGATG
GACATGCTTTTGGTCTCCACGTTCCACACAGTTTCAGAGCGAGCCAGTCTCGGGTCGGTCAGGGAGATGAA
ACCCTCCGGGCACTCCCGCATCTGCACCTCACAGCTCAACAGCTGAGGATTGTCCTCGGTGGTCGGGATCA
CGGTTATCTGGAAGAAGCAGAAGAGCGGCGGTGGGAATCATAGTCCGCGAACGGGATCGGCCGGTGGTGT
CGCATCAGGCCCCGCAGCAGTCGCTGCCGCCGCCGCTCCGTCAAGCTGCTGCTCAGGGGGTCCGGGTCCAG
GGACTCCCTCAGCATGATGCCCACGGCCCTCAGCATCAGTCGTCGGTGCGGCGGGCGCAGCAGCGCATGC
GGATCTCGCTCAGGTCGCTGCAGTACGTGCAACACAGAACCACCAGGTTGTTCAACAGTCCATAGTTCAAC
ACGCTCCAGCCGAAACTCATCGCGGGAAGGATGCTACCCACGTGGCCGTCGTACCAGATCCTCAGGTAAG
CAAGTGGTGCCCCCTCCAGAACACGCTGCCCACGTACATGATCTCCTTGGGCATGTGGCGGTTCACCACCTC
CCGGTACCACATCACCCTCTGGTTGAACATGCAGCCCCGGATGATCCTGCGGAACCACAGGGCCAGCACCG
CCCCGCCCGCCATGCAGCGAAGAGACCCCGGGTCCCGGCAATGGCAATGGAGGACCCACCGCTCGTACCC
GTGGATCATCTGGGAGCTGAACAAGTCTATGTTGGCACAGCACAGGCATATGCTCATGCATCTCTTCAGCA
CTCTCAACTCCTCGGGGGTCAAAACCATATCCCAGGGCACGGGGAACTCTTGCAGGACAGCGAACCCCGCA
GAACAGGGCAATCCTCGCACAGAACTTACATTGTGCATGGACAGGGTATCGCAATCAGGCAGCACCGGGT
GATCCTCCACCAGAGAAGCGCGGGTCTCGGTCTCCTCACAGCGTGGTAAGGGGGCCGGCCGATACGGTG
ATGGCGGGACGCGGCTGATCGTGTTCGCGACCGTGTCATGATGCAGTTGCTTTCGGACATTTTCGTACTTGC
TGTAGCAGAACCTGGTCCGGGCGCTGCACACCGATXGCCGGCGGCGGTCTCGGCGCTTGGAACGCTCGGTG
TTGAAATTGTAAAACAGCCACTCTCTCAGACCGTGCAGCAGATCTAGGGCCTCAGGAGTGATGAAGATCCC
ATCATGCCTGATGGCTCTGATCACATCGACCACCGTGGAATGGGCCAGACCCAGCCAGATGATGCAATTTT
GTTGGGTTTCGGTGACGGCGAGCCTCGGGAACAACGATGAAGTAAATGCAAGCGGTGCGTTCCAGCATGGT
TAGTTAGCTGATCTGTAGAAAAAACAAAAATGAACATTAAACCATGCTAGCCTGGCGAACAGGTGGGTAA
ATCGTTCTCTCCAGCACCAGGCAGGCCACGGGGTCTCCGGCGCGACCCTCGTAAAAATTGTCGCTATGATT
GAAAACCATCACAGAGACGTTCCCGGTGGCCGGCGTGAATGATTCGACAAGATGAATACACCCCCGGA
ACATTGGCGTCCGCGAGTGAAAAAAAGCGCCCGAGGAAGCAATAAGGCACTACAATGCTCAGTCTCAAGT
CCAGCAAAGCGATGCCATGCGGATGAAGCACAAAATTCTCAGGTGCGTACAAAATGTAATTACTCCCCTCC
TGCACAGGCAGCAAAGCCCCCGATCCCTCCAGGTACACATACAAAGCCTCAGCGTCCATAGCTTACCGAGC
```

-continued

```
AGCAGCACACAACAGGCGCAAGAGTCAGAGAAAGGCTGAGCTCTAACCTGTCCACCCGCTCTCTGCTCAAT

ATATAGCCCAGATCTACACTGACGTAAAGGCCAAAGTCTAAAAATACCCGCCAAATAATCACACACGCCCA

GCACACGCCCAGAAACCGGTGACACACTCAAAAAAATACGCGCACTTCCTCAAACGCCCAAAACTGCCGT

CATTTCCGGGTTCCCACGCTACGTCATCAAAACACGACTTTCAAATTCCGTCGACCGTTAAAAACGTCACCC

GCCCCGCCCCTAACGGTCGCCCGTCTCTCAGCCAATCAGCGCCCCGCATCCCCAAATTCAAACACCTCATTT

GCATATTAACGCGCACAAAAAGTTTGAGGTATATTATTGATGATG
```

XXIII. Immunogenicity in the TETr-Regulated Cassette Expression System

Figure 48:
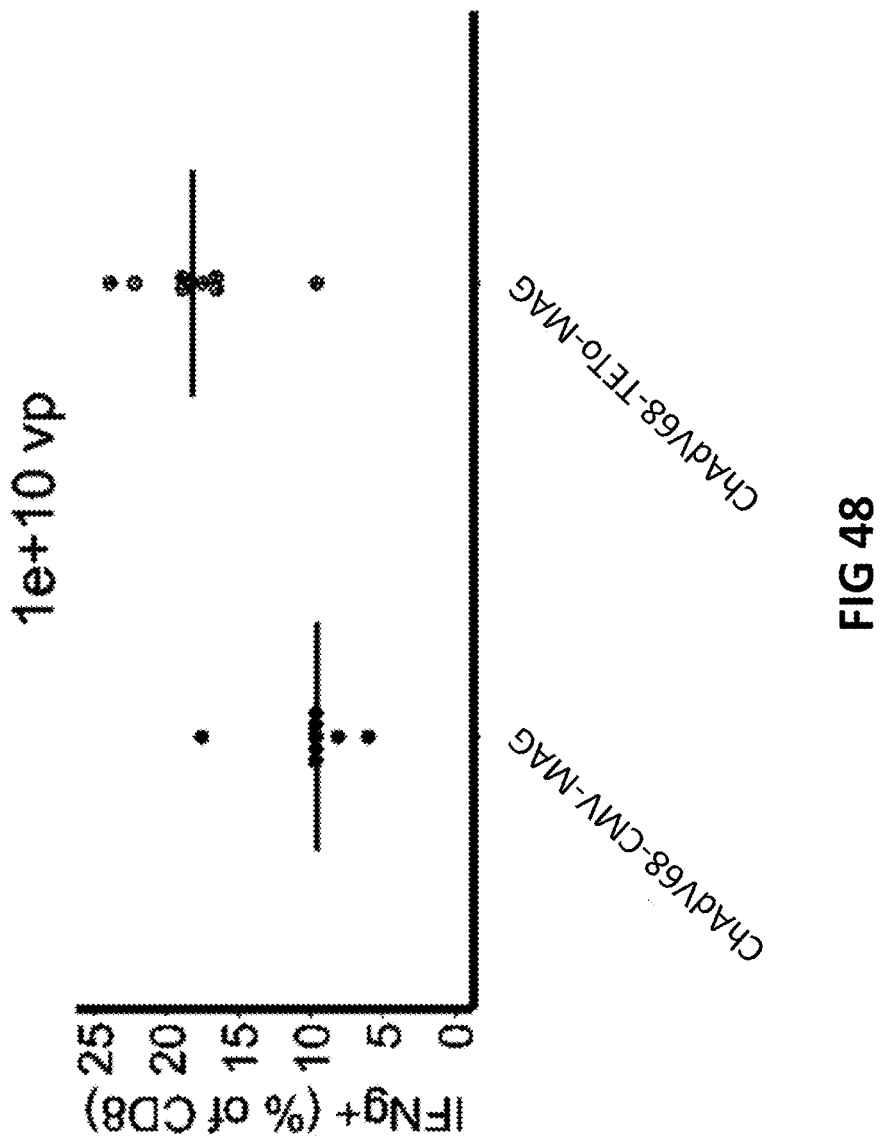
FIG. 48 shows antigen specific T-Cell responses following vaccination with regulated versus no-regulated vectors. Antigen-specific IFN-gamma production in CD8 T cells measured using ICS and results presented as antigen-specific CD8 T cells as a percentage of total CD8 T cells. Median for each group indicated by horizontal line. Balb/c mice were immunized with 1×10$^{10}$ VP of ChAdV68 vaccines expressing a model antigen cassette either under control of normal CMV promoter (ChAdV-MAG) or a TETo regulated promoter (TET-ChAdV-MAG). 12 d post vaccination spleens were harvested and single cell suspensions made.

Balb/c mice were immunized with $1\times10^{10}$ VP of ChAdV68 vaccines expressing a model antigen cassette either under control of normal CMV promoter (ChAdV-MAG) or a TETo regulated promoter (TET-ChAdV-MAG). 12 d post vaccination spleens were harvested and single cell suspensions made. Antigen-specific IFN-gamma production in CD8 T cells was measured using ICS. As shown in FIG. 48 and Table 43, in vivo efficacy was the same or better when mice were immunized with the antigen cassette expressed from the TETo regulated promoter. Thus, the regulated ChAd vector was equally potent, and potentially more so, at inducing CD8+ immune responses to the vaccine targets in vivo.

As described in greater detail above, Rhesus macaques were also immunized with ChAdV68.5WTnt.MAG25mer ("ChAdV68-CMV-MAG"; SEQ ID NO:2) or ChAdV68-E4d-CMT-MAG (SEQ ID NO:71), with each group also administered an anti-CTLA4 antibody (Ipilimumab). T cell responses were analyzed for IFN-gamma production by ELISpot following stimulation with 6 different rhesus macaque Mamu-A*01 class I epitopes. As shown in FIG. 42B and FIG. 42C, and quantified in Table 41B (ChAdV68-CMV-MAG) and Table 41C (ChAdV68-E4d-CMT-MAG), immunization with a construct featuring a "CMT" response region in E4-deleted vector background demonstrated at least equivalent immune responses, with a positive trend towards an increased response in CMT-E4-deleted vectors.

TABLE 43

% CD8+ response in ChAdV68-MAG and ChAdV68-Teto-MAG immunized mice

| ChAdV68-MAG1e10 VP | Mouse # | % CD8+ | ChAdV68-TETo-MAG 1e10 VP | Mouse # | % CD8+ |
|---|---|---|---|---|---|
| | 1 | 9.35 | | 1 | 17.58 |
| | 2 | 9.31 | | 2 | 16.88 |
| | 3 | 17.60 | | 3 | 18.93 |
| | 4 | 10.08 | | 4 | 9.59 |
| | 5 | 6.06 | | 5 | 24 |
| | 6 | 8.15 | | 6 | 16.28 |
| | 7 | 10.08 | | 7 | 18.92 |
| | 8 | 9.87 | | 8 | 22.24 |
| Median | | 9.61 | Median | | 18.25 |

XXIV. Selection of Patient Populations

One or more antigens are used to formulate a vaccine composition using a modified adenovirus, such as the E4 modified adenovirus, described herein. The vaccine is administered to a patient, e.g., to treat cancer. In certain instances the patient is selected, e.g., using a companion diagnostic or a commonly use cancer gene panel NGS assay such as FoundationOne, FoundationOne CDx, Guardant 360, Guardant OMNI, or MSK IMPACT. Exemplary patient selection criteria are described below.

Patient Selection

Patient selection for shared neoantigen vaccination is performed by consideration of tumor gene expression, somatic mutation status, and patient HLA type. Specifically, a patient is considered eligible for the vaccine therapy if:
(a) the patient carries an HLA allele predicted or known to present an epitope included in a vaccine and the patient tumor expresses a gene with the epitope sequence, or
(b) the patient carries an HLA allele predicted or known to present an epitope included in a vaccine, and the patient tumor carries the mutation giving rise to the epitope sequence, or
(c) Same as (b), but also requiring that the patient tumor expresses the gene with the mutation above a certain threshold (e.g., 1 TPM or 10 TPM), or
(d) Same as (b), but also requiring that the patient tumor expresses the mutation above a certain threshold (e.g., at least 1 mutated read observed at the level of RNA)
(e) Same as (b), but also requiring both additional criteria in (c) and (d)
(f) Any of the above, but also optionally requiring that loss of the presenting HLA allele is not detected in the tumor Gene expression is measured at the RNA or protein level by any of the established methods including RNASeq, microarray, PCR, Nanostring, ISH, Mass spectrometry, or IHC. Thresholds for positivity of gene expression is established by several methods, including: (1) predicted probability of presentation of the epitope by the HLA allele at various gene expression levels, (2) correlation of gene expression and HLA epitope presentation as measured by mass spectrometry, and/or (3) clinical benefits of vaccination attained for patients expressing the genes at various levels. Patient selection is further extended to require positivity for greater than 1 epitope, for examples, at least 2, 3, 4 or 5 epitopes included in the vaccine.

Somatic mutational status is assessed by any of the established methods, including exome sequencing (NGS DNASeq), targeted exome sequencing (panel of genes), transcriptome sequencing (RNASeq), Sanger sequencing, PCR-based genotyping assays (e.g., Taqman or droplet digital PCR), Mass-spectrometry based methods (e.g., by Sequenom), or any other method known to those skilled in the art.

Additional new shared neoantigens are identified using any of the methods described, e.g., by mass spectrometry. These newly identified shared neoantigens are incorporated into the vaccine cassettes described herein.

Previously validated neoantigens are additionally validated as being presented by additional HLA alleles and informs neoantigen selection for the vaccine cassette and/or expands the potential treatable population.

Inclusions of a new neoantigen enables the broadening of addressable tumor type (e.g., EGFR mutated NSCLC) or inclusion of patients with a new tumor type.

Certain Sequences

Vectors, cassettes, and antibodies referred to herein are described below and referred to by SEQ ID NO.

```
Full-Length ChAdVC68 sequence "ChAdV68.5WTnt"(SEQ ID NO: 1); AC_000011.1
sequence with corresponding ATCC VR-594 nucleotides substituted at five
positions; W at position 6 = A or T
CCATCWTCAATAATATACCTCAAACTTTTTGTGCGCGTTAATATGCAAATGAGGCGTTTGAATTTGGGGAGGA

AGGGCGGTGATTGGTCGAGGGATGAGCGACCGTTAGGGGCGGGGCGAGTGACGTTTTGATGACGTGGTTGCG

AGGAGGAGCCAGTTTGCAAGTTCTCGTGGGAAAAGTGACGTCAAACGAGGTGTGGTTTGAACACGGAAATAC

TCAATTTTCCCGCGCTCTCTGACAGGAAATGAGGTGTTTCTGGGCGGATGCAAGTGAAAACGGGCCATTTTCG

CGCGAAAACTGAATGAGGAAGTGAAAATCTGAGTAATTTCGCGTTTATGGCAGGGAGGAGTATTTGCCGAGG

GCCGAGTAGACTTTGACCGATTACGTGGGGGTTTCGATTACCGTGTTTTTCACCTAAATTTCCGCGTACGGTGT

CAAAGTCCGGTGTTTTTACGTAGGTGTCAGCTGATCGCCAGGGTATTTAAACCTGCGCTCTCCAGTCAAGAGG

CCACTCTTGAGTGCCAGCGAGAAGAGTTTTCTCCTCCGCGCCGCGAGTCAGATCTACACTTTGAAAGATGAGG

CACCTGAGAGACCTGCCCGATGAGAAAATCATCATCGCTTCCGGGAACGAGATTCTGGAACTGGTGGTAAAT

GCCATGATGGGCGACGACCCTCCGGAGCCCCCCACCCCATTTGAGACACCTTCGCTGCACGATTTGTATGATC

TGGAGGTGGATGTGCCCGAGGACGATCCCAATGAGGAGGCGGTAAATGATTTTTTTAGCGATGCCGCGCTGC

TAGCTGCCGAGGAGGCTTCGAGCTCTAGCTCAGACAGCGACTCTTCACTGCATACCCCTAGACCCGGCAGAG

GTGAGAAAAAGATCCCCGAGCTTAAAGGGGAAGAGATGGACTTGCGCTGCTATGAGGAATGCTTGCCCCCGA

GCGATGATGAGGACGAGCAGGCGATCCAGAACGCAGCGAGCCAGGGAGTGCAAGCCGCCAGCGAGAGCTTT

GCGCTGGACTGCCCGCCTCTGCCCGGACACGGCTGTAAGTCTTGTGAATTTCATCGCATGAATACTGGAGATA

AAGCTGTGTTGTGTGCACTTTGCTATATGAGAGCTTACAACCATTGTGTTTACAGTAAGTGTGATTAAGTTGA

ACTTTAGAGGGAGGCAGAGAGCAGGGTGACTGGGCGATGACTGGTTTATTTATGTATATATGTTCTTTATATA

GGTCCCGTCTCTGACGCAGATGATGAGACCCCCACTACAAAGTCCACTTCGTCACCCCCAGAAATTGGCACAT

CTCCACCTGAGAATATTGTTAGACCAGTTCCTGTTAGAGCCACTGGGAGGAGAGCAGCTGTGGAATGTTTGGA

TGACTTGCTACAGGGTGGGGTTGAACCTTTGGACTTGTGTACCCGGAAACGCCCCAGGCACTAAGTGCCACAC

ATGTGTGTTTACTTGAGGTGATGTCAGTATTTATAGGGTGTGGAGTGCAATAAAAAATGTGTTGACTTTAAGT

GCGTGGTTTATGACTCAGGGGTGGGGACTGTGAGTATATAAGCAGGTGCAGACCTGTGTGGTTAGCTCAGAG

CGGCATGGAGATTTGGACGGTCTTGGAAGACTTTCACAAGACTAGACAGCTGCTAGAGAACGCCTCGAACGG

AGTCTCTTACCTGTGGAGATTCTGCTTCGGTGGCGACCTAGCTAGGCTAGTCTACAGGGCCAAACAGGATTAT

AGTGAACAATTTGAGGTTATTTTGAGAGAGTGTTCTGGTCTTTTTTGACGCTCTTAACTTGGGCCATCAGTCTCA

CTTTAACCAGAGGATTTCGAGAGCCCTGATTTTACTACTCCTGGCAGAACCACTGCAGCAGTAGCCTTTTTG

CTTTTATTCTTGACAAATGGAGTCAAGAAACCCATTTCAGCAGGGATTACCAGCTGGATTTCTTAGCAGTAGC

CTGAGGATCCTGAATCTCCAGGAGAGTCCCAGGGCACGCCAACGTCGCCAGCAGCAGCAGCAGGAGGAGGA

TCAAGAAGAGAACCCGAGAGCCGGCCTGGACCCTCCGGCGGAGGAGGAGGAGTAGCTGACCTGTTTCCTGAA

CTGCGCCGGGTGCTGACTAGGTCTTCGAGTGGTCGGGAGAGGGGGATTAAGCGGGAGAGGCATGATGAGACT

AATCACAGAACTGAACTGACTGTGGGTCTGATGAGTCGCAAGCGCCCAGAAACAGTGTGGTGGCATGAGGTG

CAGTCGACTGGCACAGATGAGGTGTCGGTGATGCATGAGAGGTTTTCTCTAGAACAAGTCAAGACTTGTTGGT

TAGAGCCTGAGGATGATTGGGAGGTAGCCATCAGGAATTATGCCAAGCTGGCTCTGAGGCCAGACAAGAAGT
```

-continued

ACAAGATTACTAAGCTGATAAATATCAGAAATGCCTGCTACATCTCAGGGAATGGGGCTGAAGTGGAGATCT
GTCTCCAGGAAAGGGTGGCTTTCAGATGCTGCATGATGAATATGTACCCGGGAGTGGTGGGCATGGATGGGG
TTACCTTTATGAACATGAGGTTCAGGGGAGATGGGTATAATGGCACGGTCTTTATGGCCAATACCAAGCTGAC
AGTCCATGGCTGCTCCTTCTTTGGGTTTAATAACACCTGCATCGAGGCCTGGGGTCAGGTCGGTGTGAGGGGC
TGCAGTTTTTTCAGCCAACTGGATGGGGGTCGTGGGCAGGACCAAGAGTATGCTGTCCGTGAAGAAATGCTTG
TTTGAGAGGTGCCACCTGGGGGTGATGAGCGAGGGCGAAGCCAGAATCCGCCACATGCGCCTCTACCGAGACG
GGCTGCTTTGTGCTGTGCAAGGGCAATGCTAAGATCAAGCATAATATGATCTGTGGAGCCTCGGACGAGCGC
GGCTACCAGATGCTGACCTGCGCCGGCGGGAACAGCCATATGCTGGCCACCGTACATGTGGCTTCCCATGCTC
GCAAGCCCTGGCCCGAGTTCGAGCACAATGTCATGACCAGGTGCAATATGCATCTGGGTCCCGCCGAGGCA
TGTTCATGCCCTACCAGTGCAACCTGAATTATGTGAAGGTGCTGCTGGAGCCCGATGCCATGTCCAGAGTGAG
CCTGACGGGGTGTTTGACATGAATGTGGAGGTGTGGAAGATTCTGAGATATGATGAATCCAAGACCAGGTG
CCGAGCCTGCGAGTGCGGAGGGAAGCATGCCAGTTCCAGCCCGTGTGTGTGGATGTGACGGAGGACCTGCG
ACCCGATCATTTGGTGTTGCCCTGCACCGGGACGGAGTTCGGTTCCAGCGGGGAAGAATCTGACTAGAGTGA
GTAGTGTTCTGGGGCGGGGGAGGACCTGCATGAGGGCCAGAATAACTGAAATCTGTGCTTTTCTGTGTGTTGC
AGCAGCATGAGCGGAAGCGGCTCCTTTGAGGGAGGGGTATTCAGCCCTTATCTGACGGGCGTCTCCCCTCCT
GGGCGGGAGTGCGTCAGAATGTGATGGGATCCACGGTGGACGGCCGGCCCGTGCAGCCCGCGAACTCTTCAA
CCCTGACCTATGCAACCCTGAGCTCTTCGTCGTTGGACGCAGCTGCCGCCGCAGCTGCTGCATCTGCCGCCAG
CGCCGTGCGCGGAATGGCCATGGGCGCCGGCTACTACGGCACTCTGGTGGCCAACTCGAGTTCCACCAATAA
TCCCGCCAGCCTGAACGAGGAGAAGCTGTTGCTGCTGATGGCCCAGCTCGAGGCCTTGACCCAGCGCCTGGG
CGAGCTGACCCAGCAGGTGGCTCAGCTGCAGGAGCAGACGCGGGCCGCGGTTGCCACGGTGAAATCCAAATA
AAAAATGAATCAATAAATAAACGGAGACGGTTGTTATTTTAACACAGAGTCTGAATCTTTATTTGATTTTTC
GCGCGCGGTAGGCCCTGGACCACCGGTCTCGATCATTGAGCACCCGGTGGATCTTTTCCAGGACCCGGTAGA
GGTGGGCTTGGATGTTGAGGTACATGGGCATGAGCCCGTCCCGGGGTGGAGGTAGCTCCATTGCAGGGCCT
CGTGCTCGGGGTGGTGTTGTAAATCACCCAGTCATAGCAGGGGCGCAGGGCATGGTGTTGCACAATATCTTT
GAGGAGGAGACTGATGGCCACGGGCAGCCCTTTGGTGTAGGTGTTTACAAATCTGTTGAGCTGGGAGGGATG
CATGCGGGGGGAGATGAGGTGCATCTTGGCCTGGATCTTGAGATTGGCGATGTTACCGCCCAGATCCCGCCTG
GGGTTCATGTTGTGCAGGACCACCAGCACGGTGTATCCGGTGCACTTGGGGAATTTATCATGCAACTTGGAAG
GGAAGGCGTGAAAGAATTTGGCGACGCCTTTGTGCCCGCCCAGGTTTTCCATGCACTCATCCATGATGATGGC
GATGGGCCCGTGGGCGGCGGCCTGGGCAAAGACGTTTCGGGGGTCGGAACATCATAGTTGTGGTCCTGGGT
GAGGTCATCATAGGCCATTTTAATGAATTTGGGCGGAGGGTGCCGGACTGGGGACAAAGGTACCCTCGAT
CCCGGGGGCGTAGTTCCCCTCACAGATCTGCATCTCCCAGGCTTTGAGCTCGGAGGGGGGATCATGTCCACC
TGCGGGGCGATAAAGAACACGGTTTCCGGGGCGGGGGAGATGAGCTGGGCCGAAAGCAAGTTCCGGAGCAG
CTGGGACTTGCCGCAGCCGGTGGGGCCGTAGATGACCCCGATGACCGGCTGCAGGTGGTAGTTGAGGGAGAG
ACAGCTGCCGTCCTCCCGGAGGAGGGGGCCACCTCGTTCATCATCTCGCGCACGTGCATGTTCTCGCGCACC
AGTTCCGCCAGGAGGCGCTCTCCCCCCAGGGATAGGAGCTCCTGGAGCGAGGCGAAGTTTTTCAGCGGCTTG
AGTCCGTCGGCCATGGGCATTTTGGAGAGGGTTTGTTGCAAGAGTTCCAGGCGGTCCCAGAGCTCGGTGATGT
GCTCTACGGCATCTCGATCCAGCAGACCTCCTCGTTTCGCGGGTTGGGACGGCTGCGGGAGTAGGGCACCAG
ACGATGGGCGTCCAGCGCAGCCAGGGTCCGGTCCTTCCAGGGTCGCAGCGTCCGCGTCAGGGTGGTCTCCGT
CACGGTGAAGGGGTGCGCGCCGGGCTGGGCGCTTGCGAGGGTGCGCTTCAGGCTCATCCGGCTGGTCGAAAA
CCGCTCCCGATCGGCGCCCTGCGCGTCGGCCAGGTAGCAATTGACCATGAGTTCGTAGTTGAGCGCCTCGGCC
GCGTGGCCTTTGGCGCGGAGCTTACCTTTGGAAGTCTGCCCGCAGGCGGGACAGAGGAGGGACTTGAGGGCG

-continued

```
TAGAGCTTGGGGGCGAGGAAGACGGACTCGGGGGCGTAGGCGTCCGCGCCGCAGTGGGCGCAGACGGTCTC
GCACTCCACGAGCCAGGTGAGGTCGGGCTGGTCGGGGTCAAAAACCAGTTTCCCGCCGTTCTTTTTGATGCGT
TTCTTACCTTTGGTCTCCATGAGCTCGTGTCCCCGCTGGGTGACAAAGAGGCTGTCCGTGTCCCCGTAGACCG
ACTTTATGGGCCGGTCCTCGAGCGGTGTGCCGCGGTCCTCCTCGTAGAGGAACCCCGCCCACTCCGAGACGAA
AGCCCGGGTCCAGGCCAGCACGAAGGAGGCCACGTGGGACGGGTAGCGGTCGTTGTCCACCAGCGGGTCCAC
CTTTTCCAGGGTATGCAAACACATGTCCCCCTCGTCCACATCCAGGAAGGTGATTGGCTTGTAAGTGTAGGCC
ACGTGACCGGGGGTCCCGGCCGGGGGGGTATAAAAGGGTGCGGGTCCCTGCTCGTCCTCACTGTCTTCCGGA
TCGCTGTCCAGGAGCGCCAGCTGTTGGGGTAGGTATTCCCTCTCGAAGGCGGGCATGACCTCGGCACTCAGGT
TGTCAGTTTCTAGAAACGAGGAGGATTTGATATTGACGGTGCCGGCGGAGATGCCTTTCAAGAGCCCCTCGTC
CATCTGGTCAGAAAAGACGATCTTTTTGTTGTCGAGCTTGGTGGCGAAGGAGCCGTAGAGGGCGTTGGAGAG
GAGCTTGGCGATGGAGCGCATGGTCTGGTTTTTTTCCTTGTCGGCGCGCTCCTTGGCGGCGATGTTGAGCTGC
ACGTACTCGCGCGCCACGCACTTCCATTCGGGGAAGACGGTGGTCAGCTCGTCGGGCACGATTCTGACCTGCC
AGCCCCGATTATGCAGGGTGATGAGGTCCACACTGGTGGCCACCTCGCCGCGCAGGGGCTCATTAGTCCAGC
AGAGGCGTCCGCCCTTGCGCGAGCAGAAGGGGGCAGGGGGTCCAGCATGACCTCGTCGGGGGGTCGGCA
TCGATGGTGAAGATGCCGGGCAGGAGGTCGGGGTCAAAGTAGCTGATGGAAGTGGCCAGATCGTCCAGGGC
AGCTTGCCATTCGCGCACGGCCAGCGCGCGCTCGTAGGGACTGAGGGGCGTGCCCCAGGGCATGGGATGGGT
AAGCGCGGAGGCGTACATGCCGCAGATGTCGTAGACGTAGAGGGGCTCCTCGAGGATGCCGATGTAGGTGGG
GTAGCAGCGCCCCCCGCGGATGCTGGCGCGCACGTAGTCATACAGCTCGTGCGAGGGGGCGAGGAGCCCCGG
GCCCAGGTTGGTGCGACTGGGCTTTTCGGCGCGGTAGACGATCTGGCGGAAAATGGCATGCGAGTTGGAGGA
GATGGTGGGCCTTTGGAAGATGTTGAAGTGGGCGTGGGGCAGTCCGACCGAGTCGCGGATGAAGTGGGCGTA
GGAGTCTTGCAGCTTGGCGACGAGCTCGGCGGTGACTAGGACGTCCAGAGCGCAGTAGTCGAGGGTCTCCTG
GATGATGTCATACTTGAGCTGTCCCTTTTGTTTCCACAGCTCGCGGTTGAGAAGGAACTCTTCGCGGTCCTTCC
AGTACTCTTCGAGGGGGAACCCGTCCTGATCTGCACGGTAAGAGCCTAGCATGTAGAACTGGTTGACGGCCTT
GTAGGCGCAGCAGCCCTTCTCCACGGGGAGGGCGTAGGCCTGGGCGGCCTTGCGCAGGGAGGTGTGCGTGAG
GGCGAAAGTGTCCCTGACCATGACCTTGAGGAACTGGTGCTTGAAGTCGATATCGTCGCAGCCCCCCTGCTCC
CAGAGCTGGAAGTCCGTGCGCTTCTTGTAGGCGGGGTTGGGCAAAGCGAAAGTAACATCGTTGAAGAGGATC
TTGCCCGCGCGGGGCATAAAGTTGCGAGTGATGCGGAAAGGTTGGGGCACCTCGGCCCGGTTGTTGATGACC
TGGGCGGCGAGCACGATCTCGTCGAAGCCGTTGATGTTGTGGCCCACGATGTAGAGTTCCACGAATCGCGGA
CGGCCCTTGACGTGGGGCAGTTTCTTGAGCTCCTCGTAGGTGAGCTCGTCGGGGTCGCTGAGCCCGTGCTGCT
CGAGCGCCCAGTCGGCGAGATGGGGGTTGGCGCGGAGGAAGGAAGTCCAGAGATCCACGGCCAGGGCGGTT
TGCAGACGGTCCCGGTACTGACGGAACTGCTGCCCGACGGCCATTTTTTCGGGGGTGACGCAGTAGAAGGTG
CGGGGGGTCCCCGTGCCAGCGATCCCATTTGAGCTGGAGGGCGAGATCGAGGGCGAGCTCGACGAGCCGGTCG
TCCCCGGAGAGTTTCATGACCAGCATGAAGGGGACGAGCTGCTTGCCGAAGGACCCCATCCAGGTGTAGGTT
TCCACATCGTAGGTGAGGAAGAGCCTTTCGGTGCGAGGATGCGAGCCGATGGGAAGAACTGGATCTCCTGC
CACCAATTGGAGGAATGGCTGTTGATGTGATGGAAGTAGAAATGCCGACGGCGCGCCGAACACTCGTGCTTG
TGTTTATACAAGCGGCCACAGTGCTCGCAACGCTGCACGGGATGCACGTGCTGCACGAGCTGTACCTGAGTTC
CTTTGACGAGGAATTTCAGTGGGAAGTGGAGTCGTGGCGCCTGCATCTCGTGCTGTACTACGTCGTGGTGGTC
GGCCTGGCCCTCTTCTGCCTCGATGGTGGTCATGCTGACGAGCCCGCGCGGGAGGCAGGTCCAGACCTCGGC
GCGAGCGGGTCGGAGAGCGAGGACGAGGGCGCGCAGGCCGGAGCTGTCCAGGGTCCTGAGACGCTGCGGAG
TCAGGTCAGTGGGCAGCGGCGGCGCGCGGTTGACTTGCAGGAGTTTTTCCAGGGCGCGCGGGAGGTCCAGAT
```

-continued
GGTACTTGATCTCCACCGCGCCATTGGTGGCGACGTCGATGGCTTGCAGGGTCCCGTGCCCCTGGGGTGTGAC

CACCGTCCCCGTTTCTTCTTGGGCGGCTGGGGCGACGGGGGCGGTGCCTCTTCCATGGTTAGAAGCGGCGGC

GAGGACGCGCCGGGCGGCAGGGGCGGCTCGGGGCCCGGAGGCAGGGGCGGCAGGGGCACGTCGGCGCCG

CGCGCGGGTAGGTTCTGGTACTGCGCCCGGAGAAGACTGGCGTGAGCGACGACGCGACGGTTGACGTCCTGG

ATCTGACGCCTTCTGGGTGAAGGCCACGGGACCCGTGAGTTTGAACCTGAAAGAGAGTTCGACAGAATCAATC

TCGGTATCGTTGACGGCGGCCTGCCGCAGGATCTCTTGCACGTCGCCCGAGTTGTCCTGGTAGGCGATCTCGG

TCATGAACTGCTCGATCTCCTCCTCTTGAAGGTCTCCGCGGCCGGCGCGCTCCACGGTGGCCGCGAGGTCGTT

GGAGATGCGGCCCATGAGCTGCGAGAAGGCGTTCATGCCCGCCTCGTTCCAGACGCGGCTGTAGACCACGAC

GCCCTCGGGATCGCgGGCGCGCATGACCACCTGGGCGAGGTTGAGCTCCACGTGGCGCGTGAAGACCGCGTA

GTTGCAGAGGCGCTGGTAGAGGTAGTTGAGCGTGGTGGCGATGTGCTCGGTGACGAAGAAATACATGATCCA

GCGGCGGAGCGGCATCTCGCTGACGTCGCCCAGCGCCTCCAAACGTTCCATGGCCTCGTAAAAGTCCACGGC

GAAGTTGAAAAACTGGGAGTTGCGCGCCGAGACGGTCAACTCCTCCTCCAGAAGACGGATGAGCTCGGCGAT

GGTGGCGCGCACCTCGCGCTCGAAGGCCCCCGGGAGTTCCTCCACTTCCTCTTCTTCCTCCTCCACTAACATCT

CTTCTACTICCTCCTCAGGCGGCAGTGGTGGCGGGGAGGGGGCCTGCGTCGCCGGCGGCGCACGGGCAGAC

GGTCGATGAAGCGCTCGATGGTCTCGCCGCGCCGGCGTCGCATGGTCTCGGTGACGGCGCGCCCGTCCTCGCG

GGGCCCCAGCGTGAAGACGCCGCCGCGCATCTCCAGGTGGCCGGGGGGGTCCCCGTTGGGCAGGGAGAGGG

CGCTGACGATGCATCTTATCAATTGCCCCGTAGGGACTCCGCGCAAGGACCTGAGCGTCTCGAGATCCACGC

GATCTGAAAACCGCTGAACGAAGGCTTCGAGCCAGTCGCAGTCGCAAGGTAGGCTGAGCACGGTTTCTTCTG

GCGGGTCATGTTGGTTGGGAGCGGGCGGGCGATGCTGCTGGTGATGAAGTTGAAATAGGCGGTTCTGAGAC

GGCGGATGGTGGCGAGGAGCACCAGGTCTTTGGGCCCGGCTTGCTGGATGCGCAGACGGTCGGCCATGCCCC

AGGCGTGGTCCTGACACCTGGCCAGGTCCTTGTAGTAGTCCTGCATGAGCCGCTCCACGGGCACCTCCTCCTC

GCCCGCGCGGCCGTGCATGCGCGTGAGCCCGAAGCCGCGCTGGGGCTGGACGAGCGCCAGGTCGGCGACGA

CGCGCTCGGCGAGGATGGCTTGCTGGATCTGGGTGAGGGTGGTCTGGAAGTCATTCAAAGTCGACGAAGCGGT

GGTAGGCTCCGGTGTTGATGGTGTAGGAGCAGTTGGCCATGACGGACCAGTTGACGGTCTGGTGGCCCGGAC

GCACGAGCTCGTGGTACTTGAGGCGCGAGTAGGCGCGCGTGTCGAAGATGTAGTCGTTGCAGGTGCGCACCA

GGTACTGGTAGCCGATGAGGAAGTGCGGCGGCGGCTGGCGGTAGAGCGGCCATCGCTCGGTGGCGGGGCG

CCGGGCGCGAGGTCCTCGAGCATGGTGCGGTGGTAGCCGTAGATGTACCTGGACATCCAGGTGATGCCGGCG

GCGGTGGTGGAGGCGCGCGGGAACTCGCGGACGCGGTTCCAGATGTTGCGCAGCGGCAGGAAGTAGTTCATG

GTGGGCACGGTCTGGCCCGTGAGGCGCGCAGTCGTGGATGCTCTATACGGGCAAAAACGAAAGCGGTCAG

CGGCTCGACTCCGTTGGCCTGGAGGCTAAGCGAACGGGTTGGCCTGCGCGTGTACCCCGGTTCGAATCTCGAA

TCAGGCTGGAGCCGCAGCTAACGTGGTATTGGCACTCCCGTCTCGACCCAAGCCTGCACCAACCCTCCAGGAT

ACGGAGGCGGGTCGTTTTGCAACTTTTTTTTGGAGGCCGGATGAGACTAGTAAGCGCGGAAAGCGGCCGACC

GCGATGGCTCGCTGCCGTAGTCTGGAGAAGAATCGCCAGGGTTGCGTTGCGGTGTGCCCCGGTTCGAGGCCG

GCCGGATTCCGCGGCTAACGAGGGCGTGGCTGCCCCGTCGTTTCCAAGACCCCATAGCCAGCCGACTTCTCCA

GTTACGGAGCGAGCCCCTCTTTTGTTTTGTTTGTTTTTGCCAGATGCATCCCGTACTGCGGCAGATGCGCCCCC

ACCACCCTCCACCGCAACAACAGCCCCCTCCACAGCCGGCGCTTCTGCCCCCGCCCCAGCAGCAACTTCCAGC

CACGACCGCCGCGCCGCCGTGAGCGGGGCTGGACAGAGTTATGATCACCAGCTGGCCTTGGAAGAGGGCGA

GGGGCTGGCGCGCCTGGGGCGTCGTCGCCGGAGCGGCACCCGCGCGTGCAGATGAAAAGGGACGCTCGCG

AGGCCTACGTGCCCAAGCAGAACCTGTTCAGAGACAGGAGCGGCGAGGAGCCCGAGGAGATGCGCGCGGCC

CGGTTCCACGCGGGGCGGGAGCTGCGGCGCGGCCTGGACCGAAAGAGGGTGCTGAGGGACGAGGATTTCGA

GGCGGACGAGCTGACGGGGATCAGCCCCGCGCGCGCGCACGTGGCCGCGGCCAACCTGGTCACGGCGTACG

-continued

```
AGCAGACCGTGAAGGAGGAGAGCAACTTCCAAAAATCCTTCAACAACCACGTGCGCACCCTGATCGCGCGCG

AGGAGGTGACCCTGGGCCTGATGCACCTGTGGGACCTGCTGGAGGCCATCGTGCAGAACCCCACCAGCAAGC

CGCTGACGGCGCAGCTGTTCCTGGTGGTGCAGCATAGTCGGGACAACGAAGCGTTCAGGGAGGCGCTGCTGA

ATATCACCGAGCCCGAGGGCCGCTGGCTCCTGGACCTGTGAACATTCTGCAGAGCATCGTGGTGCAGGAGC

GCGGGCTGCCGCTGTCCGAGAAGCTGGCGGCCATCAACTTCTCGGTGCTGAGTTTGGGCAAGTACTACGCTAG

GAAGATCTACAAGACCCCGTACGTGCCCATAGACAAGGAGGTGAAGATCGACGGGTTTTACATGCGCATGAC

CCTGAAAGTGCTGACCCTGAGCGACGATCTGGGGGTGTACCGCAACGACAGGATGCACCGTGCGGTGAGCGC

CAGCAGGCGGCGCGAGCTGAGCGACCAGGAGCTGATGCATAGTCTGCAGCGGGCCCTGACCGGGGCCGGGA

CCGAGGGGGAGAGCTACTTTGACATGGGCGCGGACCTGCACTGGCAGCCCAGCCGCCGGGCCTTGGAGGCGG

CGGCAGGACCCTACGTAGAAGAGGTGGACGATGAGGTGGACGAGGAGGGCGAGTACCTGGAAGACTGATGG

CGCGACCGTATTTTTGCTAGATGCAACAACAACAGCCACCTCCTGATCCCGCGATGCGGGCGGCGCTGCAGA

GCCAGCCGTCCGGCATTAACTCCTCGGACGATTGGACCCAGGCCATGCAACGCATCATGGCGCTGACGACCC

GCAACCCCGAAGCCTTTAGACAGCAGCCCCAGGCCAACCGGCTCTCGGCCATCCTGGAGGCCGTGGTGCCCT

CGCGCTCCAACCCCACGCACGAGAAGGTCCTGGCCATCGTGAACGCGCTGGTGGAGAACAAGGCCATCCGCG

GCGACGAGGCCGGCCTGGTGTACAACGCGCTGCTGGAGCGCGTGGCCCGCTACAACAGCACCAACGTGCAGA

CCAACCTGGACCGCATGGTGACCGACGTGCGCGAGGCCGTGGCCCAGCGCGAGCGGTTCCACCGCGAGTCCA

ACCTGGGATCCATGGTGGCGCTGAACGCCTTCCTCAGCACCCAGCCCGCCAACGTGCCCCGGGGCCAGGAGG

ACTACACCAACTTCATCAGCGCCCTGCGCCTGATGGTGACCGAGGTGCCCCAGAGCGAGGTGTACCAGTCCG

GGCCGGACTACTTCTTCCAGACCAGTCGCCAGGGCTTGCAGACCGTGAACCTGAGCCAGGCTTTCAAGAACTT

GCAGGGCCTGTGGGGCGTGCAGGCCCCGGTCGGGGACCGCGCGACGGTGTCGAGCCTGCTGACGCCGAACTC

GCGCCTGCTGCTGCTGCTGGTGGCCCCCTTCACGGACAGCGGCAGCATCAACCGCAACTCGTACCTGGGCTAC

CTGATTAACCTGTACCGCGAGGCCATCGGCCAGGCGCACGTGGACGAGCAGACCTACCAGGAGATCACCCAC

GTGAGCCGCGCCCTGGGCCAGGACGACCCGGGCAACCTGGAAGCCACCCTGAACTTTTTGCTGACCAACCGG

TCGCAGAAGATCCCGCCCCAGTACGCGCTCAGCACCGAGGAGGAGCGCATCCTGCGTTACGTGCAGCAGAGC

GTGGGCCTGTTCCTGATGCAGGAGGGGGCCACCCCCAGCGCCGCGCTCGACATGACCGCGCGCAACATGGAG

CCCAGCATGTACGCCAGCAACCGCCCCGTTCATCAATAAACTGATGGACTACTTGCATCGGGCGGCCGCCATG

AACTCTGACTATTTCACCAACGCCATCCTGAATCCCCACTGGCTCCCGCCGCCGGGGTTCTACACGGGCGAGT

ACGACATGCCCGACCCCAATGACGGGTTCCTGTGGGACGATGTGGACAGCAGCGTGTTCTCCCCCCGACCGG

GTGCTAACGAGCGCCCCTTGTGGAAGAAGGAAGGCAGCGACCGACGCCCGTCCTCGGCGCTGTCCGGCCGCG

AGGGTGCTGCCGCGGCGGTGCCCGAGGCCGCCAGTCCTTTCCCGAGCTTGCCCTTCTCGCTGAACAGTATCCG

CAGCAGCGAGCTGGGCAGGATCACGCGCCCGCGCTTGCTGGGCGAAGAGGAGTACTTGAATGACTCGCTGTT

GAGACCCGAGCGGGAGAAGAACTTCCCCAATAACGGGATAGAAAGCCTGGTGGACAAGATGAGCCGCTGGA

AGACGTATGCGCAGGAGCACAGGGACGATCCCCGGGCGTCGCAGGGGGCCACGAGCCGGGCAGCGCCGCC

CGTAAACGCCGGTGGCACGACAGGCAGCGGGACAGATGTGGGACGATGAGGACTCCGCCGACGACAGCAG

CGTGTTGGACTTGGGTGGGAGTGGTAACCCGTTCGCACCTGCGCCCCCGTATCGGGCGCATGATGTAAGAG

AAACCGAAAATAAATGATACTCACCAAGGCCATGGCGACCAGCGTGCGTTCGTTTCTTCTCTGTTGTTGTTGT

ATCTAGTATGATGAGGCGTGCGTACCCGGAGGGTCCTCCTCCCTCGTACGAGAGCGTGATGCAGCAGGCGAT

GGCGGCGGCGGCGATGCAGCCCCCGCTGGAGGCTCCTTACGTGCCCCCGCGGTACCTGGCGCCTACGGAGGG

GCGGAACAGCATTCGTTACTCGGAGCTGGCACCCTTGTACGATACCACCCGGTTGTACCTGGTGGACAACAA

GTCGGCGGACATCGCCGCTGAACTACCAGAACGACCACAGCAACTTCCTGACCACCGTGGTGCAGAACAA
```

-continued

```
TGACTTCACCCCCACGGAGGCCAGCACCCACACCATCAACTTTTGACGAGCGCTCGCGGTGGGGCGGCCAGCT
GAAAACCATCATGCACACCAACATGCCCAACGTGAACGAGTTCATGTACAGCAACAAGTTCAAGGCGCGGGT
GATGGTCTCCCGCAAGACCCCCAATGGGGTGACAGTGACAGAGGATTATGATGGTAGTCAGGATGAGCTGAA
GTATGAATGGGTGGAATTTGAGCTGECCCGAAGGCAACTTCTCGGTGACCATGACCATCGACCTGATGAACAA
CGCCATCATCGACAATTACTTGGCGGTGGGGCGGCAGAACGGGGTGCTGGAGAGCGACATCGGCGTGAAGTT
CGACACTAGGAACTTCAGGCTGGGCTGGGACCCCGTGACCGAGCTGGTCATGCCCGGGGTGTACACCAACGA
GGCTTTCCATCCCGATATTGTCTTGCTGCCCGGCTGCGGGGTGGACTTCACCGAGAGCCGCCTCAGCAACCTG
CTGGGCATTCGCAAGAGGCAGCCCTTCCAGGAAGGCTTCCAGATCATGTACGAGGATCTGGAGGGGGGCAAC
ATCCCCGCGCTCCTGGATGTCGACGCCTATGAGAAAAGCAAGGAGGATGCAGCAGCTGAAGCAACTGCAGCC
GTAGCTACCGCCTCTACCGAGGTCAGGGGCGATAATTTTGCAAGCGCCGCAGCAGTGGCAGCGGCCGAGGCG
GCTGAAACCGAAAGTAAGATAGTCATTCAGCCGGTGGAGAAGGATAGCAAGAACAGGAGCTACAACGTACT
ACCGGACAAGATAAACACCGCCTACCGCAGCTGGTACCTAGCCTACAACTATGGCGACCCCGAGAAGGGCGT
GCGCTCCTGGACGCTGCTCACCACCTCGGACGTCACCTGCGGCGTGGAGCAAGTCTACTGGTCGCTGCCCGAC
ATGATGCAAGACCCGGTCACCTTCCGCTCCACGCGTCAAGTTAGCAACTACCCGGTGGTGGGCGCCGAGCTCC
TGCCCGTCTACTCCAAGAGCTTCTTCAACGAGCAGGCCGTCTACTCGCAGCAGCTGCGCGCCTTCACCTCGCT
TACGCACGTCTTCAACCGCTTCCCCGAGAACCAGATCCTCGTCCGCCCGCCCGCGCCCACCATTACCACCGTC
AGTGAAAACGTTCCTGCTCTCACAGATCACGGGACCCTGCCGCTGCGCAGCAGTATCCGGGGAGTCCAGCGC
GTGACCGTTACTGACGCCAGACGCCGCACCTGCCCCTACGTCTACAAGGCCCTGGGCATAGTCGCGCCGCGC
GTCCTCTCGAGCCGCACCTTCTAAATGTCCATTCTCATCTCGCCCAGTAATAACACCGGTTGGGGCCTGCGCG
CGCCCAGCAAGATGTACGGAGGCGCTCGCCAACGCTCCACGCAACACCCCGTGCGCGTGCGCGGGCACTTCC
GCGCTCCCTGGGGCGCCCTCAAGGGCGCGTGCGGTCGCGCACCACCGTCGACGACGTGATCGACCAGGTGG
TGGCCGACGCGCGCAACTACACCCCCGCCGCCGCGCCCGTCTCCACCGTGGACGCCGTCATCGACAGCGTGG
TGGCcGACGCGCGCCGGTACGCCCGCGCCAAGAGCCGGCGGCGGCGCATCGCCCGGCGGCACCGGAGCACCC
CCGCCATGCGCGCGGCGCGAGCCTTGCTGCGCAGGGCCAGGCGCACGGGACGCAGGGCCATGCTCAGGGCG
GCCAGACGCGCGGCTTCAGGCGCCAGCGCCGGCAGGACCCGGAGACGCGCGGCCACGGCGGCGGCAGCGGC
CATCGCCAGCATGTCCCGCCCGCGGCGAGGGAACGTGTACTGGGTGCGCGACGCCGCCACCGGTGTGCGCGT
GCCCGTGCGCACCCGCCCCCCTCGCACTTGAAGATGTTCACTTCGCGATGTTGATGTGTCCCAGCGGCGAGGA
GGATGTCCAAGCGCAAATTCAAGGAAGAGATGCTCCAGGTCATCGCGCCTGAGATCTACGGCCCTGCGGTGG
TGAAGGAGGAAAGAAAGCCCCGCAAAATCAAGCGGGTCAAAAAGGACAAAAAGGAAGAAGAAAGTGATGT
GGACGGATTGGTGGAGTTTGTGCGCGAGTTCGCCCCCCGGCGGCGCGTGCAGTGGCGCGGGCGGAAGGTGCA
ACCGGTGCTGAGACCCGGCACCACCGTGGTCTTCACGCCCGGCGAGCGCTCCGGCACCGCTTCCAAGCGCTCC
TACGACGAGGTGTACGGGGATGATGATATTCTGGAGCAGGCGGCCGAGCGCCTGGGCGAGTTTGCTTACGGC
AAGCGCAGCCGTTCCGCACCGAAGGAAGAGGCGGTGTCCATCCCGCTGGACCACGGCAACCCCACGCCGAGC
CTCAAGCCCGTGACCTTGCAGCAGGTGCTGCCGACCGCGGCGCCGCGCCGGGGGTTCAAGCGCGAGGGCGAG
GATCTGTACCCCACCATGCAGCTGATGGTGCCCAAGCGCCAGAAGCTGGAAGACGTGCTGGAGACCATGAAG
GTGGACCCGGACGTGCAGCCCGAGGTCAAGGTGCGGCCCATCAAGCAGGTGGCCCCGGGCCTGGGCGTGCAG
ACCGTGGACATCAAGATTCCCACGGAGCCCATGGAAACGCAGACCGAGCCCATGATCAAGCCCAGCACCAGC
ACCATGGAGGTGCAGACGGATCCCTGGATGCCATCGGCTCCTAGTCGAAGACCCCGGCGCAAGTACGGCGCG
GCCAGCCTGCTGATGCCCAACTACGCGCTGCATCCTTCCATCATCCCCACGCCGGGCTACCGCGGCACGCGCT
TCTACCGCGGTCATACCAGCAGCCGCCGCCGCAAGACCACCACTCGCCGCCGCCGTCGCCGCACCGCCGCTG
CAACCACCCCTGCCGCCCTGGTGCGGAGAGTGTACCGCCGCGGCCGCGCACCTCTGACCCTGCCGCGCGCGC
```

-continued

```
GCTACCACCCGAGCATCGCCATTTAAACTTTCGCCtGCTTTGCAGATCAATGGCCCTCACATGCCGCCTTCGCG
TTCCCATTACGGGCTACCGAGGAAGAAAACCGCGCCGTAGAAGGCTGGCGGGAACGGGATGCGTCGCCACC
ACCACCGGCGGCGCGCGCCATCAGCAAGCGGTTGGGGGGAGGCTTCCTGCCCGCGCTGATCCCCATCATCG
CCGCGGCGATCGGGGCGATCCCCGGCATTGCTTCCGTGGCGGTGCAGGCCTCTCAGCGCCACTGAGACACAC
TTGGAAACATCTTGTAATAAACCaATGGACTCTGACGCTCCTGGTCCTGTGATGTGTTTTCGTAGACAGATGGA
AGACATCAATTTTTCGTCCCTGGCTCCGCGACACGGCACGCGGCCGTTCATGGGCACCTGGAGCGACATCGGC
ACCAGCCAACTGAACGGGGGCGCCTTCAATTGGAGCAGTCTCTGGAGCGGGCTTAAGAATTTCGGGTCCACG
CTTAAAACCTATGGCAGCAAGGCGTGGAACAGCACCACAGGGCAGGCGCTGAGGGATAAGCTGAAAGAGCA
GAACTTCCAGCAGAAGGTGGTCGATGGGCTCGCCTCGGGCATCAACGGGGTGGTGGACCTGGCCAACCAGGC
CGTGCAGCGGCAGATCAACAGCCGCCTGGACCCGGTGCCGCCCGCCGGCTCCGTGGAGATGCCGCAGGTGGA
GGAGGAGCTGCCTCCCCTGGACAAGCGGGGCGAGAAGCGACCCCGCCCCGATGCGGAGGAGACGCTGCTGA
CGCACACGGACGAGCCGCCCCCGTACGAGGAGGCGGTGAAACTGGGTCTGCCCACCACGCGCCCCATCGCGC
CCCTGGCCACCGGGGTGCTGAAACCCGAAAAGCCCGCGA.CCCTGGACTTGCCTCCTCCCCAGCCTTCCCGCCC
CTCTACAGTGGCTAAGCCCCTGCCGCCGGTGGCCGTGGCCCGCGCGCGACCCGGGGGCACCGCCCGCCCTCA
TGCGAACTGGCAGAGCACTCTGAACAGCATCGTGGGTCTGGGAGTGCAGAGTGTGAAGCGCCGCCGCTGCTA
TTAAACCTACCGTAGCGCTTAACTTGCTTGTCTGTGTGTATGTATTATGTCGCCGCCGCCGCTGTCCACCAG
AAGGAGGAGTGAAGAGGCGCGTCGCCGAGTTGCAAGATGGCCACCCCATCGATGCTGCCCCAGTGGGCGTAC
ATGCACATCGCCGGACAGGACGCTTCGGAGTACCTGAGTCCGGGTCTGGTGCAGTTTGCCCGCGCCACAGAC
ACCTACTTCAGTCTGGGGAACAAGTTTAGGAACCCCACGGTGGCGCCCACGCACGATGTGACCACCGACCGC
AGCCAGCGGCTGACGCTGCTTCGTGCCCGTGGACCGCGAGGACAACACCTACTCGTACAAAGTGCGCTAC
ACGCTGGCCGTGGGCGACAACCGCGTGCTGGACATGGCCAGCACCTACTTTGACATCCGCGGCGTGCTGGAT
CGGGGCCCTAGCTTCAAACCCTACTCCGGCACCGCCTACAACAGTCTGGCCCCCAAGGGAGCACCCAACACT
TGTCAGTGGACATATAAAGCCGATGGTGAAACTGCCACAGAAAAAACCTATACATATGGAAATGCACCCGTG
CAGGGCATTAACATCACAAAAGATGGTATTCAACTTGGAACTGACACCGATGATCAGCCAATCTACGCAGAT
AAAACCTATCAGCCTGAACCTCAAGTGGGTGATGCTGAATGGCATGACATCACTGGTACTGATGAAAAGTAT
GGAGGCAGAGCTCTTAAGCCTGATACCAAAATGAAGCCTTGTTATGGTTCTTTTGCCAAGCCTACTAATAAAG
AAGGAGGTCAGGCAAATGTGAAAACAGGAACAGGCACTACTAAAGAATATGACATAGACATGGCTTTCTTTG
ACAACAGAAGTGCGGCTGCTGCTGGCCTAGCTCCAGAAATTGTTTTGTATACTGAAAATGTGGATTTGGAAAC
TCCAGATACCCATATTGTATACAAAGCAGGCACAGATGACAGCAGCTCTTCTATTAATTTGGGTCAGCAAGCC
ATGCCCAACAGACCTAACTACATTGGTTTCAGAGACAACTTTATCGGGCTCATGTACTACAACAGCACTGGCA
ATATGGGGTGCTGGCCGGTCAGGCTTCTCAGCTGAATGCTGTGGTTGACTTGCAAGACAGAAACACCGAGC
TGTCCTACCAGCTCTTGCTTGACTCTCTGGGTGACAGAACCCGGTATTTCAGTATGTGGAATCAGGCGGTGGA
CAGCTATGATCCTGATGTGCGCATTATTGAAAATCATGGTGTTGGAGGATGAACTTCCCAACTATTGTTTCCCT
CTGGATGCTGTGGCAGAACAGATACTTATCAGGGAATTAAGGCTAATGGAACTGATCAAACCACATGGACC
AAAGATGACAGTGTCAATGATGCTAATGAGATAGGCAAGGGTAATCCATTCGCCATGGAAATCAACATCCAA
GCCAACCTGTGGAGGAACTTCCTCTACGCCAACGTGGCCCTGTACCTGCCCGACTCTTACAAGTACACGCCGG
CCAATGTTACCCTGCCCACCAACACCAACACCTACGATTACATGAACGGCCGGGTGGTGGCGCCCTCGCTGGT
GGACTCCTACATCAACATCGGGGCGCGCTGGICGCTGGATCCCATGGACAACGTGAACCCCTTCAACCACCA
CCGCAATGCGGGGCTGCGCTACCGCTCCATGCTCCTGGGCAACGGGCGCTACGTGCCCTTCCACATCCAGGTG
CCCCAGAAATTTTTCGCCATCAAGAGCCTCCTGCTCCTGCCCGGGTCCTACACCTACGAGTGGAACTTCCGCA
```

-continued
```
AGGACGTCAACATGATCCTGCAGAGCTCCCTCGGCAACGACCTGCGCACGGGCCTCCATCTCCTTCAC

CAGCATCAACCTCTACGCCACCTTCTTCCCCATGGCGCACAACACGGCCTCCACGCTCGAGGCCATGCTGCGC

AACGACACCAACGACCAGTCCTTCAACGACTACCTCTCGGCGGCCAACATGCTCTACCCCATCCCGGCCAACG

CCACCAACGTGCCCATCTCCATCCCCTCGCGCAACTGGGCCGCCTTCCGCGGCTGGTCCTTCACGCGTCTCAA

GACCAAGGAGACGCCCTCGCTGGGCTCCGGGTTCGACCCCTACTTCGTCTACTCGGGCTCCATCCCCTACCTC

GACGGCACCTTCTACCTCAACCACACCTTCAAGAAGGTCTCCATCACCTTCGACTCCTCCGTCAGCTGGCCCG

GCAACGACCGGCTCCTGACGCCCAACGAGTTCGAAATCAAGCGCACCGTCGACGGCGAGGGCTACAACGTGG

CCCAGTGCAACATGACCAAGGACTGGTTCCTGGTCCAGATGCTGGCCCACTACAACATCGGCTACCAGGCTT

CTACGTGCCCGAGGGCTACAAGGACCGCATGTACTCCTTCTTCCGCAACTTCCAGCCCATGAGCCGCCAGGTG

GTGGACGAGGTCAACTACAAGGACTACCAGGCCGTCACCCTGGCCTACCAGCACAACAACTCGGGCTTCGTC

GGCTACCTCGCGCCCACCATGCGCCAGGGCCAGCCCTACCCCGCCAACTACCCCTACCCGCTCATCGGCAAGA

GCGCCGTCACCAGCGTCACCCAGAAAAAGTTCCTCTGCGACAGGGTCATGTGGCGCATCCCCTTCTCCAGCAA

CTTCATGTCCATGGGCGCGCTCACCGACCTCGGCCAGAACATGCTCTATGCCAACTCCGCCCACGCGCTAGAC

ATGAATTTCGAAGTCGACCCCATGGATGAGTCCACCCTTCTCTATGTTGTCTTCGAAGTCTTCGACGTCGTCCG

AGTGCACCAGCCCCACCGCGGCGTCATCGAGGCCGTCTACCTGCGCACCCCCTTCTCGCCGGTAACGCCACC

ACCTAAGCTCTTGCTTCTTGCAAGCCATGGCCGCGGGCTCCGGCGAGCAGGAGCTCAGGGCCATCATCCGCG

ACCTGGGCTGCGGGCCCTACTTCCTGGGCACCTTCGATAAGCGCTTCCCGGGATTCATGGCCCCGCACAAGCT

GGCCTGCGCCATCGTCAACACGGCCGGCCGCGAGACCGGGGGCGAGCACTGGCTGGCCTTCGCCTGGAACCC

GCGCTCGAACACCTGCTACCTCTTCGACCCCTTCGGGTTCTCGGACGAGCGCCTCAAGCAGATCTACCAGTTC

GAGTACGAGGGCCTGCTGCGCCGCAGCGCCCTGGCCACCGAGGACCGCTGCGTCACCCTGGAAAAGTCCACC

CAGACCGTGCAGGGTCCGCGCTCGGCCGCCTGCGGGCTCTTCTGCTGCATGTTCCTGCACGCCTTCGTGCACT

GGCCCGACCGCCCCATGGACAAGAACCCCACCATGAACTTGCTGACGGGGGTGCCCAACGGCATGCTCCAGT

CGCCCCAGGTGGAACCCACCCTGCGCCGCAACCAGGAGGCGCTCTACCGCTTCCTCAACTCCCACTCCGCCTA

CTTTCGCTCCCACCGCGCGCGCATCGAGAAGGCCACCGCCTTCGACCGCATGAATCAAGACATGTAAACCGT

GTGTGTATGTTAAATGTCTTTAATAAACAGCACTTTCATGTTACACATGCATCTGAGATGATTTATTTAGAAAT

CGAAAGGGTTCTGCCGGGTCTCGGCATGGCCCGCGGGCAGGGACACGTTGCGGAACTGGTACTTGGCCAGCC

ACTTGAACTCGGGGATCAGCAGTTTGGGCAGCGGGGTGTCGGGGAAGGAGTCGGTCCACAGCTTCCGCGTCA

GTTGCAGGGCGCCCAGCAGGTCGGGCGCGGAGATCTTGAAATCGCAGTTGGGACCCGCGTTCTGCGCGCGGG

AGTTGCGGTACACGGGGTTGCAGCACTGGAACACCATCAGGGCCGGGTGCTTCACGCTCGCCACCACCGTCG

CGTCGGTGATGCTCTCCACGTCGAGGTCCTCGGCGTTGGCCATCCCGAAGGGGTCATCTTGCAGGTCTGCCT

TCCCATGGTGGGCACGCACCCGGGCTTGTGGTTGCAATCGCAGTGCAGGGGATCAGCATCATCTGGGCCTG

GTCGGCGTTCATCCCCGGGTACATGGCCTTCATGAAAGCCTCCAATTGCCTGAACGCCTGCTGGGCCTTGGCT

CCCTCGGTGAAGAAGACCCCGCAGGACTTGCTAGAGAACTGGTTGGTGGCGCACCCGGCGTCGTGCACGCAG

CAGCGCGCGTCGTTGTTGGCCAGCTGCACCACGCTGCGCCCCCAGCGGTTCTGGGTGATCTTGGCCCGGTCGG

GGTTCTCCTTCAGCGCGCGCTGCCCGTTCTCGCTCGCCACATCCATCTCGATCATGTGCTCCTTCTGGATCATG

GTGGTCCCGTGCAGGCACCGCAGCTTGCCCTCGGCCTCGGTGCACCCGTGCAGCCACAGCGCGCACCCGGTG

CACTCCCAGTTCTTGTGGGCGATCTGGGAATGCGCGTGCACGAAGCCCTGCAGGAAGCGGCCCATCATGGTG

GTCAGGGTCTTGTTGCTAGTGAAGGTCAGCGGAATGCCGCGGTGCTCCTCGTTGATGTACAGGTGGCAGATGC

GGCGGTACACCTCGCCCCTGCTCGGGCATCAGCTGGAAGTTGGCTTTCAGGTCGGTCTCCACGCGGTAGCGGTC

CATCAGCATAGTCATGATTTCCATACCCTTCTCCCAGGCCGAGACGATGGGCAGGCTCATAGGGTTCTTCACC

ATCATCTTAGCGCTAGCAGCCGCGGCCAGGGGGTCGCTCTCGTCCAGGGTCTCAAAGCTCCGCTTGCCGTCCT
```

-continued

```
TCTCGGTGATCCGCACCGGGGGGTAGCTGAAGCCCACGGCCGCCAGCTCCTCCTCGGCCTGTCTTTCGTCCTC
GCTGTCCTGGCTGACGTCCTGCAGGACCACATGCTTGGTCTTGCGGGGTTTCTTCTTGGGCGGCAGCGGCGGC
GGAGATGTTGGAGATGGCGAGGGGGAGCGCGAGTTCTCGCTCACCACTACTATCTCTTCCTCTTCTTGGTCCG
AGGCCACGCGGCGGTAGGTATGTCTCTTCGGGGGCAGAGGCGGAGGCGACGGGTCTCGCCGCCGCGACTTG
GCGGATGGCTGGCAGAGCCCCTTCCGCGTTCGGGGGTGCGCTCCCGGCGGCGCTCTGACTGACTTCCTCCGCG
GCCGGCCATTGTGTTCTCCTAGGGAGGAACAACAAGCATGGAGACTCAGCCATCGCCAACCTCGCCATCTGC
CCCCACCGCCGACGAGAAGCAGCAGCAGCAGAATGAAAGCTTAACCGCCCCGCCGCCCAGCCCCGCCACCTC
CGACGCGGCCGTCCCAGACATGCAAGAGATGGAGGAATCCATCGAGATTGACCTGGGCTATGTGACGCCCGC
GGAGCACGAGGAGGAGCTGGCAGTGCGCTTTTCACAAGAAGAGATACACCAAGAACAGCCAGAGCAGGAAG
CAGAGAATGAGCAGAGTCAGGCTGGGCTCGAGCATGACGGCGACTACCTCCACCTGAGCGGGGGGAGGAC
GCGCTCATCAAGCATCTTGGCCCGGCAGGCCACCATCGTCAAGGATGCGCTGCTCGACCGCACCGAGGTGCCC
CTCAGCGTGGAGGAGCTCAGCCGCGCCTACGAGTTGAACCTCTTCTCGCCGCGCGTGCCCCCCAAGCGCCAGC
CCAATGGCACCTGCGAGCCCAACCCGCGCCTCAACTTCTACCCGGTCTTCGCGGTGCCCGAGGCCCTGGCCAC
CTACCACATCTTTTTCAAGAACCAAAAGATCCCCGTCTCCTGCCGCGCCAACCGCACCCGCGCCGACGCCCTT
TTCAACCTGGGTCCCGGCGCCCGCCTACCTGATATCGCCTCCTTGGAAGAGGTTCCCAAGATCTTCGAGGGTC
TGGGCAGCGACGAGACTCGGGCCGCGAACGCTCTGCAAGGAGAAGGAGGAGAGCATGAGCACCACAGCGCC
CTGGTCGAGTTGGAAGGCGACAACGCGCGGCTGGCGGTGCTCAAACGCACGGTCGAGCTGACCCATTTCGCC
TACCCGGCTCTGAACCTGCCCCCCAAAGTCATGAGCGCGGTTCATGGACCAGGTGCTCATCAAGCGCGCGTCG
CCCATCTCCGAGGACGAGGGCATGCAAGACTCCGAGGAGGGCAAGCCCGTGGTCAGCGACGAGCAGCTGGC
CCGGTGGCTGGGTCCTAATGCTAGTCCCCAGAGTTTGGAAGAGCGGCGCAAACTCATGATGGCCGTGGTCCT
GGTGACCGTGGAGCTGGAGTGCCTGCGCCGCTTCTTCGCCGACGCGGAGACCCTGCGCAAGGTCGAGGAGAA
CCTGCACTACCTCTTCAGGCACGGGTTCGTGCGCCAGGCCTGCAAGATCTCCAACGTGGAGCTGACCAACCTG
GTCTCCTACATGGGCATCTTGCACGAGAACCGCCTGGGGCAGAACGTGCTGCACACCACCCTGCGCGGGGAG
GCCCGGCGCGACTACATCCGCGACTGCGTCTACCTCTACCTCTGCCACACCTGGCAGACGGGCATGGGCGTGT
GGCAGCAGTGTCTGGAGGAGCAGAACCTGAAAGAGCTTCTGCAAGCTTCCTGCAGAAGAACTCAAGGGTCTGT
GGACCGGGITCGACGAGCGCACCACCGCCTCGGACCTGGCCGACCTCATTTTCCCCGAGCGCCTCAGGCTGAC
GCTGCGCAACGGCCTGCCCGACTTTATGAGCCAAAGCATGTTGCAAAACTTTCGCTCTTTCATCCTCGAACGC
TCCGGAATCCTGCCCGCCACCTGCTCCGCGCTGCCCTCGGACTTCGTGCCGCTGACCTTCCGCGAGTGCCCCC
CGCCGCTGTGGAGCCACTGCTACCTGCTGCGCCTGGCCAACTACCTGGCCTACCACTCGGACGTGATCGAGGA
CGTCAGCGGCGAGGGCCTGCTCGAGTGCCACTGCCGCTGCAACCTCTGCACGCCGCACCGCTCCCTGGCCTGC
AACCCCCAGCTGCTGAGCGAGACCCAGATCATCGGCACCTTCGAGTTGCAAGGGCCCAGCGAAGGCGAGGGT
TCAGCCGCCAAGGGGGGTCTGAAACTCACCCCGGGGCTGTGGACCTCGGCCTACTTGCGCAACUTCGTGCCC
GAGGACTACCATCCCTTCGAGATCAGGTTCTACGAGGACCAATCCCATCCGCCCAAGGCCGAGCTGTCGGCCT
GCGTCATCACCCAGGGGGCGATCCTGGCCCAATTGCAAGCCATCCAGAAATCCCGCCAAGAATTCTTGCTGA
AAAAGGGCCGCGGGGTCTACCTCGACCCCCAGACCGGTGAGGAGCTCAACCCCGGCTTCCCCCAGGATGCCC
CGAGGAAACAAGAAGCTGAAAGTGGAGCTGCCGCCCCGTGGAGGATTTGGAGGAAGACTGGGAGAACAGCAG
TCAGGCAGAGGAGGAGGAGATGGAGGAAGACTGGGACAGCACTCAGGCAGAGGAGGACAGCCTGCAAGAC
AGTCTGGAGGAAGACGAGGAGGAGGCAGAGGAGGAGGTGGAAGAAGCAGCCGCCGCCAGACCGTCGTCCTC
GGCGGGGGAGAAAGCAAGCAGCACGGATACCATCTCCGCTCCGGGTCGGGGTCCCGCTCGACCACACAGTAG
ATGGGACGAGACCGGACGATTCCCGAACCCCACCACCCAGACCGGTAAGAAGGAGCGGCAGGGATACAAGT
```

-continued

```
CCTGGCGGGGGCACAAAAACGCCATCGTCTCCTGCTTGCAGGCCTGCGGGGGCAACATCTCCTTCACCCGGC

GCTACCTGCTCTTCCACCGCGGGGTGAACTTTCCCCGCAACATCTTGCATTACTACCGTCACCTCCACAGCCCC

TACTACTTCCAAGAAGAGGCAGCAGCAGCAGAAAAAGACCAGCAGAAAACCAGCAGCTAGAAAATCCACAG

CGGCGGCAGCAGGTGGACTGAGGATCGCGGCGAACGAGCCGGCGCAAACCCGGGAGCTGAGGAACCGGATC

TTTCCCACCCTCTATGCCATCTTCCAGCAGAGTCGGGGGCAGGAGCAGGAACTGAAAGTCAAGAACCGTTCTC

TGCGCTCGCTCACCCGCAGTTGTCTGTATCACAAGAGCGAAGACCAACTTCAGCGCACTCTCGAGGACGCCG

AGGCTTCTCTTCAACAAGTACTGCGCGCTCACTCTTAAAGAGTAGCCCGCGCCCGCCCAGTCGCAGAAAAGG

CGGGAATTACGTCACCTGTGCCCTTCGCCCTAGCCGCCTCCACCCATCATCATGAGCAAAGAGATTCCCACGC

CTTACATGTGGAGCTACCAGCCCCAGATGGGCCTGGCCGCCGGTGCCGCCCAGGACTACTCCACCCGCATGA

ATTGGCTCAGCGCCGGGCCCGCGATGATCTCACGGGTGAATGACATCCGCGCCCACCGAAACCAGATACTCC

TAGAACAGTCAGCGCTCACCGCCACGCCCCGCAATCACCTCAATCCGCGTAATTGGCCCGCCGCCCTGGTGTA

CCAGGAAATTCCCCAGCCCACGACCGTACTTCCGCGAGACGCCCAGGCCGAAGTCCAGCTGACTAACTC

AGGTGTCCAGCTGGCGGGCGGCGCCACCCTGTGTCGTCACCGCCCCGCTCAGGGTATAAAGCGGCTGGTGAT

CCGGGGCAGAGGCACACAGCTTCAACGACGAGGTGGTGAGCTCTTCGCTGGGTCTGCGACCTGACGGAGTCTT

CCAACTCGCCGGATCGGGGAGATCTTCCTTCACGCCTCGTCAGGCCGTCCTGACTTTGGAGAGTTCGTCCTCG

CAGCCCCGCTCGGGTGGCATCGGCACTCTCCAGTTCGTGGAGGAGTTCACTCCCTCGGTCTACTTCAACCCCT

TCTCCGGCTCCCCCGGCCACTACCCGGACGAGTTCATCCCGAACTTCGACGCCATCAGCGAGTCGGTGGACGG

CTACGATTGAATGTCCCATGGTGGCGCAGCTGACCTAGCTCGGCTTCGACACCTGGACCACTGCCGCCGCTTC

CGCTGCTTCGCTCGGGATCTCGCCGAGTTTGCCTACTTTGAGCTGCCCGAGGAGCACCCTCAGGGCCCGGCCC

ACGGAGTGCGATCGTCGTCGAAGGGGCCTCGACTCCCACCTGCTTCGGATCTTCAGCCAGCGTCCGATCCT

GGTCGAGCGCGAGCAAGGACAGACCCTTCTGACTCTGTACTGCATCTGCAACCACCCCGGCCTGCATGAAAG

TCTTTGTTGTCTGCTGTGTACTGAGTATAATAAAAGCTGAGATCAGCGACTACTCCGGACTTCCGTGTGTTCCT

GAATCCATCAACCAGTCTTTGTTCTTCACCGGGAACGAGACCGAGCTCCAGCTCCAGTGTAAGCCCCACAAGA

AGTACCTCACCTGGCTGTTCCAGGGCTCCCCGATCGCCGTTGTCAACCACTGCGACAACGACGGAGTCCTGCT

GAGCGGCCCTGCCAACCTTACTITTTCCACCCGCAGAAGCAAGCTCCAGCTCTTCCAACCCTTCCTCCCCGGG

ACCTATCAGTGCGTCTCGGGACCCTGCCATCACACCTTCCACCTGATCCCGAATACCACAGCGTCGCTCCCCG

CTACTAACAACCAAACTAACCTCCACCAACGCCACCGTCGCGACCTTTCTGAATCTAATACTACCACCCACAC

CGGAGGTGAGCTTCCGAGGTCAACCAACCTCTGGGATTTACTACGGCCCCTGGGAGGTGGTTGGGTTAATAGC

GCTAGGCCTAGTTGCGGGTGGGCTTTTGGTTCTCTGCTACCTATACCTCCCTTGCTGTTCGTACTTAGTGGTGC

TGTGTTGCTGGTTTAAGAAATGGGGAAGATCACCCTAGTGAGCTGCGGTGCGCTGGFGCGGTGTTGCTTTCG

ATTGTGGGACTGGGCGGTGCGCTGTAGTGAAGGAGAAGGCCGATCCCTGCTTGCATTTCAATCCCAACAAA

TGCCAGCTGAGTTTTCAGCCCGATGGCAATCGGTGCGCGGTACTGATCAAGTGCGGATGGGAATGCGAGAAC

GTGAGAATCGAGTACAATAACAAGACTCGGAACAATACTCTCGCGTCCGTGTGGCAGCCCGGGGACCCCGAG

TGGTACACCGTCTCTGTCCCCGGTGCTGACGGCTCCCCGCGCACCGTGAATAATACTTTCATTTTTGCGCACAT

GTGCGACACGGTCATGTGGATGAGCAAGCAGTACGATATGTGGCCCCCCACGAAGGAGAACATCGTGGTCTT

CTCCATCGCTTACAGCCTGTGCACGGCGCTAATCACCGCTATCGTGTGCCTGAGCATTCACATGCTCATCGCT

ATTCGCCCCAGAAATAATGCCGAAAAAGAAAAACAGCCATAACGTTTTTTTTCACACCTTTTTCAGACCATGG

CCTCTGTTAAATTTTTGCTTTTATTTGCCAGTCTCATTGCCGTCATTCATGGAATGAGTAATGAGAAAATTACT

ATTTACACTGGCACTAATCACACATTGAAAGGTCCAGAAAAAGCCACAGAAGTTTCATGGTATTGTTATTTTA

ATGAATCAGATGTATCTACTGAACTCTGTGGAAACAATAACAAAAAAAATGAGAGCATTACTCTCATCAAGT

TTCAATGTGGATCTGACTTAACCCTAATTAACATCACTAGAGACTATGTAGGTATGTATTATGGAACTACAGC
```

-continued

```
AGGCATTTCGGACATGGAATTTTATCAAGTTTCTGTGTCTGAACCCACCACGCCTAGAATGACCACAACCACA
AAAACTACACCTGTTACCACTATGCAGCTCACTACCAATAACATTTTTGCCATGCGTCAAATGGTCAACAATA
GCACTCAACCCACCCCACCCAGTGAGGAAATTCCCAAATCCATGATTGGCATTATTGTTGCTGTAGTTGGTGTG
CATGTTGATCATCGCCTTGTGCATGGTGTACTATGCCTTCTGCTACAGAAAGCACAGACTGAACGACAAGCTG
GAACACTTACTAAGTGTTGAATTTTAATTTTTTAGAACCATGAAGATCCTAGGCCTTTTAATTTTTTCTATCAT
TACCTCTGCTCTATGCAATTCTGACAATGAGGACGTTACTGTCGTTGTCGGATCAAATTATACACTGAAAGGT
CCAGCGAAGGGTATGCTTTCGTGGTATTGCTATTTTGGATCTGACACTACAGAAACTGAATTATGCAATCTTA
AGAATGGCAAAATTCAAATTCTAAAATTAACAATTATATATGCAATGGTACTGATCTGATACTCCTCAATAT
CACGAAATCATATGCTGGCAGTTACACCTGCCCTGGAGATGATGCTGACAGTATGATTTTTACAAAGTAACT
GTTGTTGATCCCACTACTCCACCTCCACCCACCACAACTACTCACACCACACACACAGATCAAACCGCAGCAG
AGGAGGCAGCAAAGTTAGCCTTGCAGGTCCAAGACAGTTCATTTGTTGGCATTACCCCTACACCTGATCAGCG
GTGTCCGGGGCTGCTAGTCAGCGGCATTGTCGGTGTGCTTTCGGGATTAGCAGTCATAATCATCTGCATGTTC
ATTTTTGCTTGCTGCTATAGAAGGCTTTACCGACAAAAATCAGACCCACTGCTGAACCTCTATGTTTAATTTTT
TCCAGAGTCATGAAGGCAGTTAGCGCTCTAGTTTTTTGTTCTTTGATTGGCATTGTTTTTGCAATCCTATTCCT
AAAGTTAGCTTTATTAAAGATGTGAATGTTACTGAGGGGGGCAATGTGACACTGGTAGGTGTAGAGGGTGCT
GAAAACACCACCTGGACAAAATACCACCTCAATGGGTGGAAAGATATTTGCAATTGGAGTGTATTAGTTTAT
ACATGTGAGGGAGTTAATCTTACCATTGTCAATGCCACCTCAGCTCAAAATGGTAGAATTCAAGGACAAAGT
GTCAGTGTATCTAATGGGTATTTTACCCAACATACTTTTATCTATGACGTTAAAGTCATACCACTGCCTACGCC
TAGCCCACCTAGCACTACCACACAGACAACCCACACTACACAGACAACCACATACAGTACATTAAATCAGCC
TACCACCACTACAGCAGCAGAGGTTGCCAGCTCGTCTGGGGTCCGAGTGGCATTTTTGATGTGGGCCCCATCT
AGCAGTCCCACTGCTAGTACCAATGAGCAGACTACTGAATTTTTGTCCACTGTCGAGAGCCACACCACAGCTA
CCTCCAGTGCCTTCTCTAGCACCGCCAATCTCTCCTCGCTTTCCTCTACACCAATCAGTCCCGCTACTACTCCT
AGCCCCGCTCCTCTTCCCACTCCCCTGAAGCAAACAGACGGCGGCATGCAATGGCAGATCACCCTGCTCATTG
TGATCGGGTTGGTCATCCTGGCCGTGTTGCTCTACTACATCTTCTGCCGCCGCATTCCCAACGCGCACCGCAA
GCCGGTCTACAAGCCCATCATTGTCGGGCAGCCGGAGCCGCTTCAGGTGGAAGGGGGTCTAAGGAATCTTCT
CTTCTCTTTTACAGTATGGTGATTGAACTATGATTCCTAGACAATTCTTGATCACTATTCTTATCTGCCTCCTCC
AAGTCTGTGCCACCCTCGCTCTGGTGGCCAACGCCAGTCCAGACTGTATTGGGCCCTTCGCCTCCTACGTGCT
CTTTGCCTTCACCACCTGCATCTGCTGCTGTAGCATAGTCTGCCTGCTTATCACCTTCTTCCAGTTCATTGACTG
GATCTTTGIGCGCATCGCCTACCTGCGCCACCACCCCCAGTACCGCGACCAGCGAGTGGCGCGGCTGCTCAGG
CTCCTCTGATAAGCATGCGGGCTCTGCTACTTCTCGCGCTTCTGCTGTTAGTGCTCCCCCGTCCCGTCGACCCC
CGGTCCCCCACCCAGTCCCCCGAGGAGGTCCGCAAATGCAAATTCCAAGAACCCTGGAAATTCCTCAAATGC
TACCGCCAAAAATCAGACATGCATCCCAGCTGGATCATGATCATTGGGATCGTGAACATTCTGGCCTGCACCC
TCATCTCCTTTGTGATTTACCCCTGCTTTGACTTTGGTTGGAACTCGCCAGAGGCGCTCTATCTCCCGCCTGAA
CCTGACACACCACCACAGCAACCTCAGGCACACGCACTACCACCACTACAGCCTAGGCCACAATACATGCCC
ATATTAGACTATGAGGCCGAGCCACAGCGACCCATGCTCCCCGCTATTAGTTACTTCAATCTAACCGGCGGAG
ATGACTGACCCACTGGCCAACAACAACGTCAACGACCTTCTCCTGGACATGGACGGCCGCGCCTCGGAGCAG
CGACTCGCCCAACTTCGCATTCGCCAGCAGCAGGAGAGACCGTCAAGGAGCTGCAGGATGCGGTGGCCATC
CACCAGTGCAAGAGAGGCATCTTCTGCCTGGTGAAACAGGCCAAGATCTCCTACGAGGTCACTCCAAACGAC
CATCGCCTCTCCTACGAGCTCCTGCAGCAGCGCCAGAAGTTCACCTGCCTGGTCGGAGTCAACCCCATCGTCA
TCACCCAGCAGTCTGGCGATACCAAGGGGTGCATCCACTGCTCCTGCGACTCCCCCGACTGCGTCCACACTCT
```

-continued

```
GATCAAGACCCTCTGCGGCCTCCGCGACCTCCTCCCCATGAACTAATCACCCCCTTATCCAGTGAAATAAAGA

TCATATTGATGATGATTTTACAGAAATAAAAAATAATCATTTGATTTGAAATAAAGATACAATCATATTGATG

ATTTGAGTTTAACAAAAAAATAAAGAATCACTTACTTGAAATCTGATACCAGGTCTCTGTCCATGTTTTCTGC

CAACACCACTTCACTCCCCTCTTCCCAGCTCTGGTACTGCAGGCCCCGGCGGGCTGCAAACTTCCTCCACACG

CTGAAGGGGATGTCAAATTCCTCCTGTCCCTCAATCTTCATTTTATCTTCTATCAGATGTCCAAAAAGCGCGTC

CGGGTGGATGATGACTTCGACCCCGTCTACCCCTACGATGCAGACAACGCACCGACCGTCCCTTCATCAACC

CCCCCTTCGTCTCTTCAGATGGATTCCAAGAGAAGCCCCTGGGGGTGTTGTCCCTGCGACTGGCCGACCCCGT

CACCACCAAGAACGGGGAAATCACCCTCAAGCTGGGAGAGGGGGTGGACCTCGATTCCTCGGGAAAACTCAT

CTCCAACACGGCCACCAAGGCCGCCGCCCCTCTCAGTTTTTCCAACAACACCATTTCCCTTAACATGGATCAC

CCCTTTTACACTAAAGATGGAAAATTATCCTTACAAGTTTCTCCACCATTAAATATACTGAGAACAAGCATTC

TAAACACACTAGCTTTAGGTTTTGGATCAGGTTTAGGACTCCGTGGCTCTGCCTTGGCAGTACAGTTAGTCTCT

CCACTTACATTTGATACTGATGGAAACATAAAGCTTACCTTAGACAGAGGTTTGCATGTTACAACAGGAGATG

CAATTGAAAGCAACATAAGCTGGGCTAAAGGTTTAAAATTTGAAGATGGAGCCATAGCAACCAACATTGGAA

ATGGGTTAGAGTTTGGAAGCAGTAGTACAGAAACAGGTGTTGATGATGCTTACCCAATCCAAGTTAAACTTG

GATCTGGCCTTAGCTTTGACAGTACAGGAGCCATAATGGCTGGTAACAAAGAAGACGATAAACTCACTTTGT

GGACAACACCTGATCCATCACCAAACTGTCAAATACTCGCAGAAAATGATGCAAAACTAACACTTTGCTTTGA

CTAAATGTGGTAGTCAAATACTGGCCACTGTGTCAGTCTTAGTTGTAGGAAGTGGAAACCTAAACCCCATTAC

TGGCACCGTAAGCAGTGCTCAGGTGTTTCTACGTTTTGATGCAAACGGTGTTCTTTTAACAGAACATTCTACA

CTAAAAAATACTGGGGGTATAGGCAGGGAGATAGCATAGATGGCACTCCATATACCAATGCTGTAGGATTC

ATGCCCAATTTAAAAGCTTATCCAAAGTCACAAAGTTCTACTACTAAAAATAATATAGTAGGGCAAGTATAC

ATGAATGGAGATGTTTCAAAACCTATGCTTCTCACTATAACCCTCAATGGTACTGATGACAGCAACAGTACAT

ATTCAATGTCATTTTCATACACCTGGACTAATGGAAGCTATGTTGGAGCAACATTTGGGCTAACTCTTATAC

CTTCTCATACATCGCCCAAGAATGAACACTTGTATCCCACCCTGCATGCCAACCCTTCCCACCCCACTCTGTGG

AACAAACTCTGAAACACAAAATAAAATAAAGTTCAAGTGTTTTATTGATTCAACAGTTTTACAGGATTCGAGC

AGTTATTTTTCCTCCACCCTCCCAGGACATGGAATACACCACCCTCTCCCCCCGCACAGCCTTGAACATCTGA

ATGCCATTGGTGATGGACATGCTTTTGGTCTCCACGTTCCACACAGTTTCAGAGCGAGCCAGTCTCGGGTCGG

TCAGGGAGATGAAACCCTCCGGGCACTCCCGCATCTGCACCTCACAGCTCAACAGCTGAGGATTGTCCTCGGT

GGTCGGGATCACGGTTATCTGGAAGAAGCAGAAGAGCGGCGGTGGGAATCATAGTCCGCGAACGGGATCGG

CCGGTGGTGTCGCATCAGGCCCCGCAGCAGTCGCTGCCGCCGCCGCTCCGTTCAAGCTGCTTGCTCAGGGGTCC

GGGTCCAGGGACTCCCTCAGCATGATGCCCACGGCCCTCAGCATCAGTCGTCTGGTGCGGCGGGCGCAGCAG

CGCATGCGGATCTCGCTCAGGTCGCTGCAGTACGTGCAACACAGAACCACCAGGTTGTTCAACAGTCCATAGT

TCAACACGCTCCAGCCGAAACTCATCGCGGGAAGGATGCTACCCACGTGGCCGTCGTACCAGATCCTCAGGT

AAATCAAGTGGTGCCCCCTCCAGAACACGCTGCCCACGTACATGATCTCCTTGGGCATGTGGCGGTTCACCAC

CTCCCGGTACCACATCACCCTCTGGTTGAACATGCAGCCCCGGATGATCCTGCGGAACCACAGGGCCAGCAC

CGCCCCGCCCGCCATGCAGCGAAGAGACCCCGGGTCCCGGCAATGGCAATGGAGGACCCACCGCTCGTACCC

GTGGATCATCTGGGAGCTGAACAAGTCTATGTTGGCACAGCACAGGCATATGCTCATGCATCTCTTCAGCACT

CTCAACTCCTCGGGGGTCAAAACCATATCCCAGGGCACGGGGAACTCTTGCAGGACAGCGAACCCCGCAGAA

CAGGGCAATCCTCGCACAGAACTTACATTGTGCATGGACAGGGTATCGCAATCAGGCAGCACCGGGTGATCC

TCCACCAGAGAAGCGCGGGTCTCGGTCTCCTCACAGCGTGGTAAGGGGGCCGGCCGATACGGGTGATGGCGG

GACGCGGCTGATCGTGTTCGCGACCGTGTCATGATGCAGTTGCTTTCGGACATTTTCGTACTTGCTGTAGCAG

AACCTGGTCCGGGCGCTGCACACCGATCGCCGGCGGCGGTCTCGGCGCTTGGAACGCTCGGTGTTGAAATTGT
```

-continued

```
AAAACAGCCACTCTCTCAGACCGTGCAGCAGATCTAGGGCCTCAGGAGTGATGAAGATCCCACATGCCTGA
TGGCTCTGATCACATCGACCACCGTGGAATGGGCCAGACCCAGCCAGATGATGCAATTTTGTTGGGTTTCGGT
GACGGCGGGGGAGGGAAGAACAGGAAGAACCATGATTAACTTTTAATCCAAACGGTCTCGGAGTACTTCAAA
ATGAAGATCGCGGAGATGGCACCTCTCGCCCCCGCTGTGTTGGTGGAAAATAACAGCCAGGTCAAAGGTGAT
ACGGTTCTCGAGATGTTCCACGGTGGCTTCCAGCAAAGCCTCCACGCGCACATCCAGAAACAAGACAATAGC
GAAAGCGGGAGGGTICTCTAATTCCTCAATCATCATGTTACACTCCTGCACCATCCCCAGATAATTTTCATTTT
TCCAGCCTTGAATGATTCGAACTAGTTCcTGAGGTAAATCCAAGCCAGCCATGATAAAGAGCTCGCGCAGAGC
GCCCTCCACCGGCATTCTTAAGCACACCCTCATAATTCCAAGATATTCTGCTCCTGGTTCACCTGCAGCAGATT
GACAAGCGGAATATCAAAATCTCTGCCGCGATCCCTGAGCTCCTCCCTCAGCAATAACTGTAAGTACTCTTTC
ATATCCTCTCCGAAATTTTTAGCCATAGGACCACCAGGAATAAGATTAGGGCAAGCCACAGTACAGATAAAC
CGAAGTCCTCCCCAGTGAGCATTGCCAAATGCAAGACTGCTATAAGCATGCTGGCTAGACCCGGTGATATCTT
CCAGATAACTGGACAGAAAATCGCCCAGGCAATTTTTAAGAAAATCAACAAAAGAAAAATCCTCCAGGTGGA
CGTTTAGAGCCTCGGGAACAACGATGAAGTAAATGCAAGCGGTGCGTTCCAGCATGGTTAGTTAGCTGATCT
GTAGAAAAAACAAAAATGAACATTAAACCATGCTAGCCTGGCGAACAGGTGGGTAAATCGTTCTCTCCAGCA
CCAGGCAGGCCACGGGCUCTCCGGCGCGACCCTCGTAAAAATTGTCGCTATGATTGAAAACCATCACAGAGA
GACGTTCCCGGTGGCCGGCGTGAATGATTCGACAAGATGAATACACCCCGGAACATTGGCGTCCGCGAGTG
AAAAAAAGCGCCCGAGGAAGCAATAAGGCACTACAATGCTCAGTCCAAGTCCAGCAAAGCGATGCCATGC
GGATGAAGCACAAAATTCTCAGGTGCGTACAAAATGTAATTACTCCCCTCCTGCACAGGCAGCAAAGCCCCC
GATCCCTCCAGGTACACATACAAAGCCTCAGCGTCCATAGCTTACCGAGCAGCAGCACACAACAGGCGCAAG
AGTCAGAGAAAGGCTGAGCTCTAACCTGTCCACCCGCTCTCTGCTCAATATATAGCCCAGATCTACACTGACG
TAAAGGCCAAAGTCTAAAAATACCCGCCAAATAATCACACACGCCCAGCACACGCCCAGAAACCGGTGACAC
ACTCAAAAAAATACGCGCACTTCCTCAAACGCCCAAAACTGCCGTCATTTCCGGGTTCCCACGCTACGTCATC
AAAACACGACTTTCAAATTCCGTCGACCGTTAAAAACGTCACCCGCCCCGCCCCTAACGGTCGCCCGTCTCTC
AGCCAATCAGCGCCCCGCATCCCCAAATTCAAACACCTCATTTGCATATTAACGCGCACAAAAAGTTTGAGGT
ATATTATTGATGATGG
```

Tremelimumab VL (SEQ ID NO: 16)

Tremelimumab VH (SEQ ID NO: 17)

Tremelimumab VH CDR (SEQ ID NO: 18)

Tremelimumab VH CDR2 (SEQ ID NO: 19)

Tremelimumab VH CDR3 (SEQ ID NO: 20)

Tremelimumab VL CDR1 (SEQ ID NO: 21)

Tremelimumab VL CDR2 (SEQ ID NO: 22)

Tremelimumab VL CDR3 (SEQ ID NO: 23)

Durvalumab (MEDI4736) VL (SEQ ID NO: 24)

MEDI4736 VH (SEQ ID NO: 25)

MEDI4736 VH CDR1 (SEQ ID NO: 26)

MEDI4736 VH CDR2 (SEQ ID NO: 27)

MEDI4736 VH CDR3 (SEQ ID NO: 28)

MEDI4736 VL CDR1 (SEQ ID NO: 29)

MEDI4736 VL CDR2 (SEQ ID NO: 30)

-continued

MEDI4736 VL CDR3 (SEQ ID NO: 31)

UbA76-25merPDTT nucleotide (SEQ ID NO: 32)

UbA76-25merPDTT polypeptide (SEQ ID NO: 33)

MAG-25merPDTT nucleotide (SEQ ID NO: 34)

MAG-25merPDTT polypeptide (SEQ ID NO: 35)

Ub7625merPDTT_NoSFL nucleotide (SEQ ID NO: 36)

Ub7625merPDTT_NoSFL polypeptide (SEQ ID NO: 37)

ChAdV68.5WTnt.MAG25mer (SEQ ID NO: 2); AC_000011.1 with E1 (nt 577 to 3403) and E3 (nt 27, 125-31, 825) sequences deleted; corresponding ATCC VR-594 nucleotides substituted at five positions; model neoantigen cassette under the control of the CMV promoter/enhancer inserted in place of deleted E1; SV40 polyA 3' of cassette Venezuelan equine encephalitis virus [VEE] (SEQ ID NO: 3) GenBank: L01442.2

VEE-MAG25mer (SEQ ID NO: 4); contains MAG-25merPDTT nucleotide (bases 30-1755)

Venezuelan equine encephalitis virus strain TC-83 [TC-83] (SEQ ID NO: 5) GenBank: L01443.1

VEE Delivery Vector (SEQ ID NO: 6); VEE genome with nucleotides 7544-11175 deleted [alphavirus structural proteins removed]

TC-83 Delivery Vector(SEQ ID NO: 7); TC-83 genome with nucleotides 7544-11175 deleted [alphavirus structural proteins removed]

VEE Production Vector (SEQ ID NO: 8); VEE genome with nucleotides 7544-11175 deleted, plus 5' T7-promoter, plus 3' restriction sites TC-83 Production Vector(SEQ ID NO: 9); TC-83 genome with nucleotides 7544-11175 deleted, plus 5' T7-promoter, plus 3' restriction sites VEE-UbAAY (SEQ ID NO: 14); VEE delivery vector with MHC class I mouse tumor epitopes SIINFEKL and AH1-A5 inserted VEE-Luciferase (SEQ ID NO: 15); VEE delivery vector with luciferase gene inserted at 7545 ubiquitin (SEQ ID NO: 38) > UbG76 0-228

Ubiquitin A76 (SEQ ID NO: 39) > UbA76 0-228

HLA-A2 (MHC class I) signal peptide (SEQ ID NO 40) > MHC SignalPep 0-78

HLA-A2 (MHC class I) Trans Membrane domain (SEQ ID NO: 41) > HLA A2 TM Domain 0-201

IgK Leader Seq (SEQ ID NO: 42) > IgK Leader Seq 0-60

Human DC-Lamp (SEQ ID NO: 43) > HumanDCLAMP 0-3178

Mouse LAMP1 (SEQ ID NO: 44) > MouseLamp1 0-1858

Human Lamp1 cDNA (SEQ ID NO: 45) > Human Lamp1 0-2339

Tetanus toxoid nulceic acid sequence (SEQ ID NO: 46)

Tetanus toxoid amino acid sequence (SEQ ID NO: 47)

PADRE nulceotide sequence (SEQ ID NO: 48)

PADRE amino acid sequence (SEQ ID NO: 49)

WPRE (SEQ ID NO: 50) > WPRE 0-593

IRES (SEQ ID N0: 51) > eGFP_IRES_SEAP_Insert 1746-2335

GFP (SEQ ID NO: 52)

SEAP (SEQ ID NO: 53)

Firefly Luciferase (SEQ ID NO: 54)

-continued

FMDV 2A (SEQ ID NO: 55)

ChAdV68-MAG-E4deleted (SEQ ID NO: 57)

CATCaTCAATAATATACCTCAAACTTTTTGTGCGCGTTAATATGCAAATGAGGCGTTTGAATTTGGGGAGGAA

GGGCGGTGATTGGTCGAGGGATGAGCGACCGTTAGGGGCGGGGCGAGTGACGTTTTGATGACGTGGTTGCGA

GGAGGAGCCAGTTTGCAAGTTCTCGTGGGAAAAGTGACGTCAAACGAGGTGTGGTTTGAACACGGAAATACT

CAATTTTCCCGCGCTCTCTGACAGGAAATGAGGTGTTTCTGGGCGGATGCAAGTGAAAACGGGCCATTTTCGC

GCGAAAACTGAATGAGGAAGTGAAAATCTGAGTAATTTCGCGTTTATGGCAGGGAGGAGTATTTGCCGAGGG

CCGAGTAGACTTTGACCGATTACGTGGGGGTTTCGATTACCGTGTTTTTCACCTAAATTTCCGCGTACGGTGTC

AAAGTCCGGTGTTTTTACGTAGGTGTCAGCTGATCGCCAGGGTATTTAAACCTGCGCTCTCCAGTCAAGAGGC

CACTCTTGAGTGCCAGCGAGAAGAGTTTTCTCCTCCGCGCCGCGAGTCAGATCTACACTTTGAAAGTAGGGAT

AACAGGGTAATgacattgattattgactagttGttaaTAGTAATCAATTACGGGGTCATTAGTTCATAGCCCATATAT

GGAGTTCCGCGTTACATAACTTACGGTAAATGGCCCGCCTGGCTGACCGCCCAACGACCCCCGCCCATTGACGTCAATA

ATGACGTATGTTCCCATAGTAACGCCAATAGGGACTTTCCATTGACGTCAATGGGTGGAGTATTTACGGTAAA

CTGCCCACTTGGCAGTACATCAAGTGTATCATATGCCAAGTCCGCCCCCTATTGACGTCAATGACGGTAAATG

GCCCGCCTGGCATTATGCCCAGTACATGACCTTACGGGACTTTCCTACTTGGCAGTACATCTACGTATTAGTC

ATCGCTATTACCATGgTGATGCGGTTTTGGCAGTACACCAATGGGCGTGGATAGCGGTTTGACTCACGGGGAT

TTCCAAGTCTCCACCCCATTGACGTCAATGGGAGTTTGTTTTGGCACCAAAATCAACGGGACTTTCCAAAATG

TCGTAATAACCCCGCCCCGTTGACGCAAATGGGCGGTAGGCGTGTACGGTGGGAGGTCTATATAAGCAGAgcT

CGTTTAGTGAACCGTCAGATCGCCTGGAACGCCATCCACGCTGTTTTGACCTCCATAGAAGACAGCGATCGCG ccaccATGGCCGGGATGTTCCAGGCACTGTCCGAAGGCTGCACACCCTATGATATTAACCAGATGCTGAATGTC

CTGGGAGACCACCAGGTCTCTGGCCTGGAGCAGCTGGAGAGCATCATCAACTTCGAGAAGCTGACCGAGTGG

ACAAGCTCCAATGTGATGCCTATCCTGTCCCCACTGACCAAGGGCATCCTGGGCTTCGTGTTTACCCTGACAG

TGCCTTCTGAGCGGGCCTGTCTTGCATCAGCGAGGCAGACGCAACCACACCAGAGTCCGCCAATCTGGGCG

AGGAGATCCTGTCTCAGCTGTACCTGTGGCCCCGGGTGACATATCACTCCCCTTCTTACGCCTATCACCAGTTC

GAGCGGAGAGCCAAGTACAAGAGACACTTCCCAGGCTTTGGCCAGTCTCTGCTGTTCGGCTACCCCGTGTACG

TGTTCGGCGATTGCGTGCAGGGCGACTGGGATGCCATCCGGTTTAGATACTGCGCACCACCTGGATATGCACT

GCTGAGGTGTAACGACACCAATTATTCCGCCCTGCTGGCAGTGGGCGCCCTGGAGGGCCCTCGCAATCAGGA

TTGGCTGGGCGTGCCAAGGCAGCTGGTGACACGCATGCAGGCCATCCAGAACGCAGGCCTGTGCACCCTGGT

GGCAATGCTGGAGGAGACAATCTTCTGGCTGCAGGCCTTTCTGATGGCCCTGACCGACAGCGGCCCCAAGAC

AAACATCATCGTGGATTCCCAGTACGTGATGGGCATCTCCAAGCCTTCTTTCCAGGAGTTTGTGGACTGGGAG

AACGTGAGCCCAGAGCTGAATTCCACCGATCAGCCATTCTGGCAGGCAGGAATCCTGGCAAGGAACCTGGTG

CCTATGGTGGCCACAGTGCAGGGCCAGAATCTGAAGTACCAGGGCCAGAGCCTGGTCATCAGCGCCTCCATC

ATCGTGTTTAACCTGCTGGAGCTGGAGGGCGACTATCGGGACGATGGCAACGTGTGGGTGCACACCCCACTG

AGCCCCAGAACACTGAACGCCTGGGTGAAGGCCGTGGAGGAGAAGAAGGGCATCCCAGTGCACCTGGAGCT

GGCCTCCATGACCAATATGGAGCTGATGTCTAGCATCGTGCACCAGCAGGTGAGGACATACGGACCCGTGTT

CATGTGCCTGGGAGGCCTGCTGACCATGGTGGCAGGAGCCGTGTGGCTGACAGTGCGGGTGCTGGAGCTGTT

CAGAGCCGCCCAGCTGGCCAACGATGTGGTGCTGCAGATCATGGAGCTGTGCGGAGCAGCCTTTCGCCAGGT

GTGCCACACCACAGTGCCATGGCCCAATGCCTCCCTGACCCCCAAGTGGAACAATGAGACAACACAGCCTCA

GATCGCCAACTGTAGCGTGTACGACTTCTTCGTGTGGCTGCACTACTATAGCGTGAGGGATACCCTGTGGCCC

CGCGTGACATACCACATGAATAAGTACGCCTATCACATGCTGGAGAGGCGCGCCAAGTATAAGAGAGGCCCT

```
GGCCCAGGCGCAAAGTTTGTGGCAGCATGGACCCTGAAGGCCGCCGCCGGCCCCGGCCCCGGCCAGTATATC
AAGGCTAACAGTAAGTTCATTGGAATCACAGAGCTGGGACCCGGACCTGGATAATGAGTTTAAACTCCCATT
TAAATGTGAGGGTTAATGCTTCGAGCAGACATGATAAGATACATTGATGAGTTTGGACAAACCACAACTAGA
ATGCAGTGAAAAAAATGCTTTATTTGTGAAATTTGTGATGCTATTGCTTTATTTGTAACCATTATAAGCTGCAA
TAAACAAGTTAACAACAACAATTGCATTCATTTTATGTTTCAGGTTCAGGGGAGATGTGGGAGGTTTTTTAA
AGCAAGTAAAACCTCTACAAATGTGGTAAAATAACTATAACGGTCCTAAGGTAGCGAGTGAGTAGTGTTCTG
GGGCGGGGAGGACCTGCATGAGGGCCAGAATAACTGAAATCTGTGCTTTTCTGTGTGTTGCAGCAGCATGA
GCGGAAGCGGCTCCTTTGAGGGAGGGGTATTCAGCCCTTATCTGACGGGGCGTCTCCCCTCCTGGGCGGGAGT
GCGTCAGAATGTGATGGGATCCACGGTGGACGGCCGGCCCGTGCAGCCCGCGAACTCTTCAACCCTGACCTA
TGCAACCCTGAGCTCTTCGTCGTTGGACGCAGCTGCCGCCGCAGCTGCTGCATCTGCCGCCAGCGCCGTGCGC
GGAATGGCCATGGGCGCCGGCTACTACGGCACTCTGGTGCCAACTCGAGTTCCACCAATAATCCCGCCAGC
CTGAACGAGGAGAAGCTGTTGCTGCTGATGGCCCAGCTCGAGGCCTTGACCCAGCGCCTGGGCGAGCTGACC
CAGCAGGTGGCTCAGCTGCAGGAGCAGACGCGGGCCGCGGTTGCCACGGTGAAATCCAAATAAAAAATGAA
TCAATAAATAAACGGAGACGGTTGTTGATTTTAACACAGAGTCTGAATCTTTATTTGATTTTTCGCGCGCGGT
AGGCCCTGGACCACCGGTCTCGATCATTGAGCACCCGGTGGATCTTTTCCAGGACCCGGTAGAGGTGGGCTTG
GATGTTGAGGTACATGGGCATGAGCCCGTCCCGGGGGTGGAGGTAGCTCCATTGCAGGGCCTCGTGCTCGGG
GGTGGTGTTGTAAATCACCCAGTCATAGCAGGGGCGCAGGGCATGGTGTTGCACAATATCTTTGAGGAGGAG
ACTGATGGCCACGGGCAGCCCTTTGGTGTAGGTGTTTACAAATCTGTTGAGCTGGGAGGGATGCATGCGGGG
GGAGATGAGGTGCATCTTGGCCTGGATCTTGAGATTGGCGATGTTACCGCCCAGATCCCGCCTGGGGTTCATG
TTGTGCAGGACCACCAGCACGGTGTATCCGGTGCACTTGGGGAATTTATCATGCAACTTGGAAGGGAAGGCG
TGAAAGAATTTGGCGACGCCTTTGTGCCCGCCCAGGTTTTCCATGCACTCATCCATGATGATGGCGATGGGCC
CGTGGGCGGCGGCCTGGGCAAAGACGTTTCGGGGGTCGGACACATCATAGTTGTGGTCCTGGGTGAGGTCAT
CATAGGCCATTTTAATGAATTTGGGGCGGAGGGTGCCGGACTGGGGGACAAAGGTtCCCTCGATCCCGGGGC
GTAGTTCCCCTCACAGATCTGCATCTCCCAGGCTTTGAGCTCGGAGGGGGGATCATGTCCACCTGCGGGCG
ATAAAGAACACGGTTTCCGGGGCGGGGAGATGAGCTGGCCGAAAGCAAGTTCCGGAGCAGCTGGGACTT
GCCGCAGCCGGTGGGGCCGTAGATGACCCCGATGACCGGCTGCAGGTGGTAGTTGAGGGAGAGACAGCTGCC
GTCCTCCCGGAGGAGGGGGGCCACCTCGTTCATCATCTCGCGCACGTGCATGTTCTCGCGCACCAGTTCCGCC
AGGAGGCGCTCTCCCCCCAGGGATAGGAGCTCCTGGAGCGAGGCGAAGTTTTTCAGCGGCTTGAGTCCGTCG
GCCATGGGCATTTTGGAGAGGGTTTGTTGCAAGAGTTCCAGGCGGTCCCAGAGCTCGGTGATGTGCTCTACGG
CATCTCGATCCAGCAGACCTCCTCGTTTCGCGGGTTGGGACGGCTGCGGGAGTAGGGCACCAGACGATGGGC
GTCCAGCGCAGCCAGGGTCCGGTCCTTCCAGGGTCGCAGCGTCCGCGTCAGGGTGGTCTCCGTCACGGTGAA
GGGGTGCGCGCCGGGCTGGGCGCTTGCGAGGGTGCGCTTCAGGCTCATCCGGCTGGTCGAAAACCGCTCCCG
ATCGGCGCCCTGCGCGTCGGCCAGGTAGCAATTGACCATGAGTTCGTAGTTGAGCGCCTCGGCCGCGTGGCCT
TTGGCGCGGAGCTTACCTTTGGAAGTCTGCCCGCAGGCGGGACAGAGGAGGGACTTGAGGGCGTAGAGCTTG
GGGGCGAGGAAGACGGACTCGGGGGCGTAGGCGTCCGCGCCGCAGTGGGCGCAGACGGTCTCGCACTCCAC
GAGCCAGGTGAGGTCGGGCTGGTCGGGGTCAAAAACCAGTTTCCCGCCGTTCTTTTTGATGCGTTTCTTACCT
TTGGTCTCCATGAGCTCGTGTCCCCGCTGGGTGACAAAGAGGCTGTCCGTGTCCCCGTAGACCGACTTTATGG
GCCGGTCCTCGAGCGGTGTGCCGCGGTCCTCCTCGTAGAGGAACCCCGCCCACTCCGAGACGAAAGCCCGGG
TCCAGGCCAGCACGAAGGAGGCCACGTGGGACGGGTAGCGGTCGTTGTCCACCAGCGGGTCCACCTTTTCCA
GGGTATGCAAACACATGTCCCCCTCGTCCACATCCAGGAAGGTGATTGGCTTGTAAGTGTAGGCCACGTGACC
GGGGGTCCCGGCCGGGGGGGTATAAAAGGGTGCGGGTCCCTGCTCGTCCTCACTGTCTTCCGGATCGCTGTCC
```

```
AGGAGCGCCAGCTGTTGGGGTAGGTATTCCCTCTCGAAGGCGGGCATGACCTCGGCACTCAGGTTGTCAGTTT
CTAGAAACGAGGAGGATTTGATATTGACGGTGCCGGCGGAGATGCCTTTCAAGAGCCCCTCGTCCATCTGGTC
AGAAAAGACGATCTTTTTGTTGTCGAGCTTGGTGGCGAAGGAGCCGTAGAGGGCGTTGGAGAGGAGCTTGGC
GATGGAGCGCATGGTCTGGTTTTTTCCTTGTCGGCGCGCTCCTTGGCGGCGATGTTGAGCTGCACGTACTCGC
GCGCCACGCACTTCCATTCGGGGAAGACGGTGGTCAGCTCGTCGGGCACGATTCTGACCTGCCAGCCCCGATT
ATGCAGGGTGATGAGGTCCACACTGGTGGCCACCTCGCCGCGCAGGGGCTCATTAGTCCAGCAGAGGCGTCC
GCCCTTGCGCGAGCAGAAGGGGGGCAGGGGGTCCAGCATGACCTCGTCGGGGGGTCGGCATCGATGGTGA
AGATGCCGGGCAGGAGGTCGGGGTCAAAGTAGCTGATGGAAGTGGCCAGATCGTCCAGGGCAGCTTGCCATT
CGCGCACGGCCAGCGCGCGCTCGTAGGGACTGAGGGGCGTGCCCCAGGGCATGGGATGGGTAAGCGCGGAG
GCGTACATGCCGCAGATGTCGTAGACGTAGAGGGGCTCCTCGAGGATGCCGATGTAGGTGGGGTAGCAGCGC
CCCCCGCGGATGCTGGCGCGCACGTAGTCATACAGCTCGTGCGAGGGGGCGAGGAGCCCCGGGCCCAGGTTG
GTGCGACTGGGCTTTTCGGCGCGGTAGACGATCTGGCGGAAAATGGCATGCGAGTTGGAGGAGATGGTGGGC
CTTTGGAAGATGTTGAAGTGGGCGTGGGGCAGTCCGACCGAGTCGCGGATGAAGTGGGCGTAGGAGTCTTGC
AGCTTGGCGACGAGCTCGGCGGTGACTAGGACGTCCAGAGCGCAGTAGTCGAGGGTCTCCTGGATGATGTCA
TACTTGAGCTGTCCCTTTTGTTTCCACAGCTCGCGGTTGAGAAGGAACTCTTCGCGGTCCTTCCAGTACTCTTC
GAGGGGGAACCCGTCCTGATCTGCACGGTAAGAGCCTAGCATGTAGAACTGGTTGACGGCCTTGTAGGCGCA
GCAGCCCTTCTCCACGGGGAGGGCGTAGGCCTGGGCGGCCTTGCGCAGGGAGGTGTGCGTGAGGGCGAAAGT
GTCCCTGACCATGACCTTGAGGAACTGGTGCTTGAAGTCGATATCGTCGCAGCCCCCTGCTCCCAGAGCTGG
AAGTCCGTGCGCTTCTTGTAGGCGGGGTTGGGCAAAGCGAAAGTAACATCGTTGAAGAGGATCTTGCCCGCG
CGGGGCATAAAGTTGCGAGTGATGCGAAAGGTTGGGGCACCTCGGCCCGGTTGTTGATGACCTGGGCGGCG
AGCACGATCTCGTCGAAGCCGTTGATGTTGTGGCCCACGATGTAGAGTTCCACGAATCGCGGACGGCCCTTGA
CGTGGGCAGTTTCTTGAGCTCCTCGTAGGTGAGCTCGTCGGGGTCGCTGAGCCCGTGCTGCTCGAGCGCCCA
GTCGGCGAGATGGGGGTTGGCGCGGAGGAAGGAAGTCCAGAGATCCACGGCCAGGGCGGTTTGCAGACGGT
CCCGGTACTGACGGAACTGCTGCCCGACGGCCATTTTTTCGGGGGTGACGCAGTAGAAGGTGCGGGGGTCCC
CGTGCCAGCGATCCCATTTGAGCTGGAGGGCGAGATCGAGGGCGAGCTCGACGAGCCGGTCGTCCCCGGAGA
GTTTCATGACCAGCATGAAGGGGACGAGCTGCTTGCCGAAGGACCCCATCCAGGTGTAGGTTTCCACATCGT
AGGTGAGGAAGAGCCTTTCGGTGCGAGGATGCGAGCCGATGGGAAGAACTGGATCTCCTGCCACCAATTGG
AGGAATGGCTGTTGATGTGATGGAAGTAGAAATGCCGACGGCGCGCCGAACACTCGTGCTTGTGTTTATACA
AGCGGCCACAGTGCTCGCAACGCTGCACGGGATGCACGTGCTGCACGAGCTGTACCTGAGTTCCTTTGACGA
GGAATTTCAGTGGGAAGTGGAGTCGTGGCGCCTGCATCTCGTGCTGTACTACGTCGTGGTGGTCGGCCTGGCC
CTCTTCTGCCTCGATGGTGGTCATGCTGACGAGCCCGCGCGGGAGGCAGGTCCAGACCTCGGCGCGAGCGGG
TCGGAGAGCGAGGACGAGGGCGCGCAGGCCGGAGCTGTCCAGGGTCCTGAGACGCTGCGGAGTCAGGTCAG
TGGGCAGCGGCGGCGCGCGGTTGACTTGCAGGAGTTTTTCCAGGGCGCGCGGGAGGTCCAGATGGTACTTGA
TCTCCACCGCGCCATTGGTGGCGACGTCGATGGCTTGCAGGGTCCCGTGCCCCTGGGGTGTGACCACCGTCCC
CCGTTTCTTCTTGGGCGGCTGGGGCGACGGGGCGGTGCCTCTTCCATGGTTAGAAGCGGCGGCGAGGACGC
GCGCCGGGCGGCAGGGGCGGCTCGGGGCCCGGAGGCAGGGCGGCAGGGGCACGTCGGCGCCGCGCGCGGG
TAGGTTCTGGTACTGCGCCCGGAGAAGACTGGCGTGAGCGACGACGCGACGGTTGACGTCCTGGATCTGACG
CCTCTGGGTGAAGGCCACGGGACCCGTGAGTTTGAACCTGAAAGAGAGTTCGACAGAATCAATCTCGGTATC
GTTGACGGCGGCCTGCCGCAGGATCTCTTGCACGTCGCCCGAGTTGTCCTGGTAGGCGATCTCGGTCATGAAC
TGCTCGATCTCCTCCTCTTGAAGGTCTCCGCGGCCGGCGCGCTCCACGGTGGCCGCGAGGTCGTTGGAGATGC
```

-continued

GGCCCATGAGCTGCGAGAAGGCGTTCATGCCCGCCTCGTTCCAGACGCGGCTGTAGACCACGACGCCCTCGG

GATCGCgGGCGCGCATGACCACCTGGGCGAGGTTGAGCTCCACGTGGCGCGTGAAGACCGCGTAGTTGCAGA

GGCGCTGGTAGAGGTAGTTGAGCGTGGTGGCGATGTGCTCGGTGACGAAGAAATACATGATCCAGCGGCGGA

GCGGCATCTCGCTGACGTCGCCCAGCGCCTCCAAACGTTCCATGGCCTCGTAAAAGTCCACGGCGAAGTTGA

AAAACTGGGAGTTGCGCGCCGAGACGGTCAACTCCTCCTCCAGAAGACGGATGAGCTCGGCGATGGTGGCGC

GCACCTCGCGCTCGAAGGCCCCCGGGAGTTCCTCCACTTCCTCTTCTTCCTCCTCCACTAACATCTCTTCTACT

TCCTCCTCAGGCGGCAGTGGTGGCGGGGGAGGGGGCCTGCGTCGCCGGCGGCGCACGGGCAGACGGTCGATG

AAGCGCTCGATGGTCTCGCCGCGCCGGCGTCGCATGGTCTCGGTGACGGCGCGCCCGTCCTCGCGGGGCCGC

AGCGTGAAGACGCCGCCGCGCATCTCCAGGTGGCCGGGGGGGTCCCCGTTGGGCAGGGAGAGGGCGCTGAC

GATGCATCTTATCAATTGCCCCGTAGGGACTCCGCGCAAGGACCTGAGCGTCTCGAGATCCACGGGATCTGA

AAACCGCTGAACGAAGGCTTCGAGCCAGTCGCAGTCGCAAGGTAGGCTGAGCACGGTTTCTTCTGGCGGGTC

ATGTTGGTTGGGAGCGGGGCGGGCGATGCTGCTGGTGATGAAGTTGAAATAGGCGGTTCTGAGACGGCGGAT

GGTGGCGAGGAGCACCAGGTCTTTGGGCCCGGCTTGCTGGATGCGCAGACGGTCGGCCATGCCCCAGGCGTG

GTCCTGACACCTGGCCAGGTCCTTGTAGTAGTCCTGCATGAGCCGCTCCACGGGCACCTCCTCCTCGCCCGCG

CGGCCGTGCATGCGCGTGAGCCCGAAGCCGCGCTGGGGCTGGACGAGCGCCAGGTCGGCGACGACGCGCTCG

GCGAGGATGGCTTGCTGGATCTGGGTGAGGGTGGTCTGGAAGTCATCAAAGTCGACGAAGCGGTGGTAGGCT

CCGGTGTTGATGGTGTAGGAGCAGTTGGCCATGACGGACCAGTTGACGGTCTGGTGGCCCGGACGCACGAGC

TCGTGGTACTTGAGGCGCGAGTAGGCGCGCGTGTCGAAGATGTAGTCGTTGCAGGTGCGCACCAGGTACTGG

TAGCCGATGAGGAAGTGCGGCGGCGGCTGGCGGTAGAGCGGCCATCGCTCGGTGGCGGGGGCGCCGGGCGC

GAGGTCCTCGAGCATGGTGCGGTGGTAGCCGTAGATGTACCTGGACATCCAGGTGATGCCGGCGGCGGTGGT

GGAGGCGCGCGGGAACTCGCGGACGCGGTTCCAGATGTTGCGCAGCGGCAGGAAGTAGTTCATGGTGGGCAC

GGTCTGGCCCGTGAGGCGCGCGCAGTCGTGGATGCTCTATACGGGCAAAAACGAAAGCGGTCAGCGGCTCGA

CTCCGTGGCCTGGAGGCTAAGCGAACGGGTTGGGCTGCGCGTGTACCCCGGTTCGAATCTCGAATCAGGCTG

GAGCCGCAGCTAACGTGGTATTGGCACTCCCGTCTCGACCCAAGCCTGCACCAACCCTCCAGGATACGGAGG

CGGGTCGTTTTGCAACTTTTTTTTGGAGGCCGGATGAGACTAGTAAGCGCGGAAAGCGGCCGACCGCGATGG

CTCGCTGCCGTAGTCTGGAGAAGAATCGCCAGGGTTGCGTTGCGGTGTGCCCCGGTTCGAGGCCGGCCGGATT

CCGCGGCTAACGAGGGCGTGGCTGCCCCGTCGTTTCCAAGACCCCATAGCCAGCCGACTTCTCCAGTTACGGA

GCGAGCCCCTCTTTTGTTTTGTTTGTTTTTGCCAGATGCATCCCGTACTGCGGCAGATGCGCCCCCACCACCCT

CCACCGCAACAACAGCCCCCTCCACAGCCGGCGCTTCTGCCCCCGCCCCAGCAGCAACTTCCAGCCACGACC

GCCGCGGCCGCCGTGAGCGGGGCTGGACAGAGTTATGATCACCAGCTGGCCTTGGAAGAGGGCGAGGGGCT

GGCGCGCCTGGGGCGTCGTCGCCGGAGCGGCACCCGCGCGTGCAGATGAAAAGGGACGCTCGCGAGGCCT

ACGTGCCCAAGCAGAACCTGTTCAGAGACAGGAGCGGCGAGGAGCCCGAGGAGATGCGCGCGGCCCGGTTC

CACGCGGGGCGGGAGCTGCGGCGCGGCCTGGACCGAAAGAGGGTGCTGAGGGACGAGGATTTCGAGGCGGA

CGAGCTGACGGGGATCAGCCCCGCGCGCGCGCACGTGGCCGCGGCCAACCTGGTCACGGCGTACGAGCAGAC

CGTGAAGGAGGAGAGCAACTTCCAAAAATCCTTCAACAACCACGTGCGCACCCTGATCGCGCGCGAGGAGGT

GACCCTGGGCCTGATGCACCTGTGGGACCTGCTGGAGGCCATCGTGCAGAACCCCACCAGCAAGCCGCTGAC

GGCGCAGCTGTTCCTGGTGGTGCAGCATAGTCGGGACAACGAAGCGTTCAGGGAGGCGCTGCTGAATATCAC

CGAGCCCGAGGGCCGCTGGCTCCTGGACCTGGTGAACATTCTGCAGAGCATCGTGGTGCAGGAGCGCGGGCT

GCCGCTGTCCGAGAAGCTGGCCGGCCATCAACTTCTCGGTGCTGAGTTTGGGCAAGTACTACGCTAGGAAGAT

CTACAAGACCCCGTACGTGCCCATAGACAAGGAGGTGAAGATCGACGGGTTTTACATGCGCATGACCCTGAA

AGTGCTGACCCTGAGCGACGATCTGGGGGTGTACCGCAACGACAGGATGCACCGTGCGGTGAGCGCCAGCAG

```
GCGGCGCGAGCTGAGCGACCAGGAGCTGATGCATAGTCTGCAGCGGGCCCTGACCGGGGCCGGGACCGAGG

GGGAGAGCTACTTTGACATGGGCGCGGACCTGCACTGGCAGCCCAGCCGCCGGGCCTTGGAGGCGGCGGCAG

GACCCTACGTAGAAGAGGTGGACGATGAGGTGGACGAGGAGGGCGAGTACCTGGAAGACTGATGGCGCGAC

CGTATTTTTGCTAGATGCAACAACAACAGCCACCTCCTGATCCCGCGATGCGGGCGGCGCTGCAGAGCCAGC

CGTCCGGCATTAACTCCTCGGACGATTGGACCCAGGCCATGCAACGCATCATGGCGCTGACGACCCGCAACC

CCGAAGCCTTTAGACAGCAGCCCCAGGCCAACCGGCTCTCGGCCATCCTGGAGGCCGTGGTGCCCTCGCGCTC

CAACCCCACGCACGAGAAGGTCCTGGCCATCGTGAACGCGCTGGTGGAGAACAAGGCCATCCGCGGCGACG

AGGCCGGCCTGGTGTACAACGCGCTGCTGGAGCGCGTGGCCCGCTACAACAGCACCAACGTGCAGACCAACC

TGGACCGCATGGTGACCGACGTGCGCGAGGCCGTGGCCCAGCGCGAGCGGTTCCACCGCGAGTCCAACCTGG

GATCCATGGTGGCGCTGAACGCCTTCCTCAGCACCCAGCCCGCCAACGTGCCCCGGGGCCAGGAGGACTACA

CCAACTTCATCAGCGCCCTGCGCCTGATGGTGACCGAGGTGCCCCAGAGCGAGGTGTACCAGTCCGGGCCGG

ACTACTTCTTCCAGACCAGTCGCCAGGGCTTGCAGACCGTGAACCTGAGCCAGGCTTTCAAGAACTTGCAGGG

CCTGTGGGGCGTGCAGGCCCCGGTCGGGGACCGCGCGACGGTGTCGAGCCTGCTGACGCCGAACTCGCGCCT

GCTGCTGCTGCTGGTGGCCCCCTTCACGGACAGCGGCAGCATCAACCGCAACTCGTACCTGGGCTACCTGATT

AACCTGTACCGCGAGGCCATCGGCCAGGCGCACGTGGACGAGCAGACCTACCAGGAGATCACCCACGTGAGC

CGCGCCCTGGGCCAGGACGACCCGGGCAACCTGGAAGCCACCCTGAACTTTTTGCTGACCAACCGGTCGCAG

AAGATCCCGCCCCAGTACGCGCTCAGCACCGAGGAGGAGCGCATCCTGCGTTACGTGCAGCAGAGCGTGGGC

CTGTTCCTGATGCAGGAGGGGCCACCCCCAGCGCCGCGCTCGACATGACCGCGCGCAACATGGAGCCCAGC

ATGTACGCCAGCAACCGCCCGTTCATCAATAAACTGATGGACTACTTGCATCGGGCGGCCGCCATGAACTCTG

ACTATTTCACCAACGCCATCCTGAATCCCCACTGGCTCCCGCCGCCGGGGTTCTACACGGGCGAGTACGACAT

GCCCGACCCCAATGACGGGTTCCTGTGGGACGATGTGGACAGCAGCGTGTTCTCCCCCCGACCGGGTGCTAA

CGAGCGCCCCTTGTGGAAGAAGGAAGGCAGCGACCGACGCCCGTCCTCGGCGCTGTCCGGCCGCGAGGGTGC

TGCCGCGGCGGTGCCCGAGGCCGCCAGTCCTTTCCCGAGCTTGCCCTTCTCGCTGAACAGTATCCGCAGCAGC

GAGCTGGGCAGGATCACGCGCCCGCGCTTGCTGGGCAAGAGGAGTACTTGAATGACTCGCTGTTGAGACCC

GAGCGGGAGAAGAACTTCCCCAATAACGGGATAGAAAGCCTGGTGGACAAGATGAGCCGCTGGAAGACGTA

TGCGCAGGAGCACAGGGACGATCCCCGGGCGTCGCAGGGGGCCACGAGCCGGGGCAGCGCCGCCCGTAAAC

GCCGGTGGCACGACAGGCAGCGGGACAGATGTGGGACGATGAGGACTCCGCCGACGACAGCAGCGTGTTG

GACTTGGGTGGGAGTGGTAACCCGTTCGCTCACCTGCGCCCCCGTATCGGGCGCATGATGTAAGAGAAACCG

AAAATAAATGATACTCACCAAGGCCATGGCGACCAGCGTGCGTTCGTTTCTTCTCTGTTGTTGTTGTATCTAGT

ATGATGAGGCGTGCGTACCCGGAGGGTCCTCCTCCCTCGTACGAGAGCGTGATGCAGCAGGCGATGGCGGCG

GCGGCGATGCAGCCCCCGCTGGAGGCTCCTTACGTGCCCCCGCGGTACCTGGCGCCTACGGAGGGGCGGAAC

AGCATTCGTTACTCGGAGCTGGCACCCTTGTACGATACCACCCGGTTGTACCTGGTGGACAACAAGTCGGCGG

ACATCGCCTCGCTGAACTACCAGAACGACCACAGCAACTTCCTGACCACCGTGGTGCAGAACAATGACTTCA

CCCCCACGGAGGCCAGCACCCAGACCATCAACTTTGACGAGCGCTCGCGGTGGGCGGCCAGCTGAAAACCA

TCATGCACACCAACATGCCCAACGTGAACGAGTTCATGTACAGCAACAAGTTCAAGGCGCGGGTGATGGTCT

CCCGCAAGACCCCCAATGGGGTGACAGTGACAGAGGATTATGATGGTAGTCAGGATGAGCTGAAGTATGAAT

GGGTGGAATTTGAGCTGCCCGAAGGCAACTTCTCGGTGACCATGACCATCGACCTGATGAACAACGCCATCA

TCGACAATTACTTGGCGGTGGGGCGGCAGAACGGGGTGCTGGAGAGCGACATCGGCGTGAAGTTCGACACTA

GGAACTTCAGGCTGGGCTGGGACCCCGTGACCGAGCTGGTCATGCCCGGGGTGTACACCAACGAGGCTTTCC

ATCCCGATATTGTCTTGCTGCCCGGCTGCGGGGTGGACTTCACCGAGAGCCGCCTCAGCAACCTGCTGGGCAT
```

-continued

```
TCGCAAGAGGCAGCCCTTCCAGGAAGGCTTCCAGATCATGTACGAGGATCTGGAGGGGGCAACATCCCCGC
GCTCCTGGATGTCGACGCCTATGAGAAAAGCAAGGAGGATGCAGCAGCTGAAGCAACTGCAGCCGTAGCTAC
CGCCTCTACCGAGGTCAGGGGCGATAATTTTGCAAGCGCCGCAGCAGTGGCAGCGGCCGAGGCGGCTGAAAC
CGAAAGTAAGATAGTCATTCAGCCGGTGGAGAAGGATAGCAAGAACAGGAGCTACAACGTACTACCGGACA
AGATAAACACCGCCTACCGCAGCTGGTACCTAGCCTACAACTATGGCGACCCCGAGAAGGGCGTGCGCTCCT
GGACGCTGCTCACCACCTCGGACGTCACCTGCGGCGTGGAGCAAGTCTACTGGTCGCTGCCCGACATGATGC
AAGACCCGGTCACCTTCCGCTCCACGCGTCAAGTTAGCAACTACCCGGTGGTGGGCGCCGAGCTCCTGCCCGT
CTACTCCAAGAGCTTCTTCAACGAGCAGGCCGTCTACTCGCAGCAGCTGCGCGCCTTCACCTCGCTTACGCAC
GTCTTCAACCGCTTCCCCGAGAACCAGATCCTCGTCCGCCCGCCCGCGCCCACCATTACCACCGTCAGTGAAA
ACGTTCCTGCTCTCACAGATCACGGGACCCTGCCGCTGCGCAGCAGTATCCGGGGAGTCCAGCGCGTGACCGT
TACTGACGCCAGACGCCGCACCTGCCCCTACGTCTACAAGGCCCTGGGCATAGTCGCCGCGCGTCCTCTCG
AGCCGCACCTTCTAAATGTCCATTCTCATCTCGCCCAGTAATAACACCGGTTGGGGCCTGCGCGCGCCCAGCA
AGATGTACGGAGGCGCTCGCCAACGCTCCACGCAACACCCCGTGCGCGTGCGCGGGCACTTCCGCGCTCCCT
GGGGCGCCCTCAAGGGCCGCGTGCGGTCGCGCACCACCGTCGACGACGTGATCGACCAGGTGGTGGCCGACG
CGCGCAACTACACCCCCGCCGCCGCGCCCGTCTCCACCGTGGACGCCGTCATCGACAGCGTGGTGGCcGACGC
GCGCCGGTACGCCCGCGCCAAGAGCCGGCGGCGGCGCATCGCCCGGCGGCACCGGAGCACCCCCGCCATGCG
CGCGGCGCGAGCCTTGCTGCGCAGGGCCAGGCGCACGGGACGCAGGGCCATGCTCAGGGCGGCCAGACGCG
CGGCTTCAGGCGCCAGCGCCGGCAGGACCCGGAGACGCGCGGCCACGGCGGCGGCAGCGGCCATCGCCAGC
ATGTCCCGCCCGCGGCGAGGGAACGTGTACTGGGTGCGCGACGCCGCCACCGGTGTGCGCGTGCCCGTGCGC
ACCCGCCCCCTCGCACTTGAAGATGTTCACTTCGCGATGTTGATGTGTCCCAGCGGCGAGGAGGATGTCCAA
GCGCAAATTCAAGGAAGAGATGCTCCAGGTCATCGCGCCTGAGATCTACGGCCCTGCGGTGGTGAAGGAGGA
AAGAAAGCCCCGCAAAATCAAGCGGGTCAAAAAGGACAAAAAGGAAGAAGAAAGTGATGTGGACGGATTG
GTGGAGTTTGTGCGCGAGTTCGCCCCCCGGCGGCGCGTGCAGTGGCGCGGGCGGAAGGTGCAACCGGTGCTG
AGACCCGGCACCACCGTGGTCTTCACGCCCGGCGAGCGCTCCGGCACCGCTTCCAAGCGCTCCTACGACGAG
GTGTACGGGGATGATGATATTCTGGAGCAGGCGGCCGAGCGCCTGGGCGAGTTTGCTTACGGCAAGCGCAGC
CGTTCCGCACCGAAGGAAGAGGCGGTGTCCATCCCGCTGGACCACGGCAACCCCACGCCGAGCCTCAAGCCC
GTGACCTTGCAGCAGGTGCTGCCGACCGCGGCGCCGCGCCGGGGGTTCAAGCGCGAGGGCGAGGATCTGTAC
CCCACCATGCAGCTGATGGTGCCCAAGCGCCAGAAGCTGGAAGACGTGCTGGAGACCATGAAGGTGGACCCG
GACGTGCAGCCCGAGGTCAAGGTGCGCCCATCAAGCAGGTGGCCCCGGGCCTGGGCGTGCAGACCGTGGAC
ATCAAGATTCCCACGGAGCCCATGGAAACGCAGACCGAGCCCATGATCAAGCCCAGCACCAGCACCATGGAG
GTGCAGACGGATCCCTGGATGCCATCGGCTCCTAGTCGAAGACCCCGGCGCAAGTACGGCGCGGCCAGCCTG
CTGATGCCCAACTACGCGCTGCATCCTTCCATCATCCCCACGCCGGGCTACCGCGGCACGCGCTTCTACCGCG
GTCATACCAGCAGCCGCCGCCGCAAGACCACCACTCGCCGCCGCCGTCGCCGCACCGCCGCTGCAACCACCC
CTGCCGCCCTGGTGCGGAGAGTGTACCGCCGCGGCCGCGCACCTCTGACCCTGCCGCGCGCGCGCTACCACCC
GAGCATCGCCATTTAAACTTTCGCCtGCTTTGCAGATCAATGGCCCTCACATGCCGCCTTCGCGTTCCCATTAC
GGGCTACCGAGGAAGAAAACCGCGCCTAGAAGGCTGGCGGGAACGGGATGCGTCGCCACCACCACCGGC
GGCGGCGCGCCATCAGCAAGCGGTTGGGGGGAGGCTTCCTGCCCGCGCTGATCCCCATCATCGCCGCGGCGA
TCGGGGCGATCCCCGGCATTGCTTCCGTGGCGGTGCAGGCCTCTCAGCGCCACTGAGACACACTTGGAAACAT
CTTGTAATAAACCaATGGACTCTGACGCTCCTGGTCCTGTGATGTGTTTTCGTAGACAGATGGAAGACATCAA
TTTTTCGTCCCTGGCTCCGCGACACGGCACGCGGCCGTTCATGGGCACCTGGAGCGACATCGGCACCAGCCAA
CTGAACGGGGCGCCTTCAATTGGAGCAGTCTCTGGAGCGGGCTTAAGAATTTCGGGTCCACGCTTAAAACCT
```

-continued

```
ATGGCAGCAAGGCGTGGAACAGCACCACAGGGCAGGCGCTGAGGGATAAGCTGAAAGAGCAGAACTTCCAG

CAGAAGGTGGTCGATGGGCTCGCCTCGGGCATCAACGGGGTGGTGGACCTGGCCAACCAGGCCGTGCAGCGG

CAGATCAACAGCCGCCTGGACCCGGTGCCGCCCGCCGGCTCCGTGGAGATGCCGCAGGTGGAGGAGGAGCTG

CCTCCCCTGGACAAGCGGGGCGAGAAGCGACCCCGCCCCGATGCGGAGGAGACGCTGCTGACGCACACGGA

CGAGCCGCCCCCGTACGAGGAGGCGGTGAAACTGGGTCTGCCCACCACGCGGCCCATCGCGCCCCTGGCCAC

CGGGGTGCTGAAACCCGAAAAGCCCGCGACCCTGGACTTGCCTCCTCCCCAGCCTTCCCGCCCCTCTACAGTG

GCTAAGCCCCTGCCGCCGGTGGCCGTGGCCCGCGCGCGACCCGGGGGCACCGCCCGCCCTCATGCGAACTGG

CAGAGCACTCTGAACAGCATCGTGGGTCTGGGAGTGCAGAGTGTGAAGCGCCGCCGCTGCTATTAAACCTAC

CGTAGCGCTTAACTTGCTTGTCTGTGTGTGTATGTATTATGTCGCCGCCGCCGCTGTCCACCAGAAGGAGGAG

TGAAGAGGCGCGTCGCCGAGTTGCAAGATGGCCACCCCATCGATGCTGCCCCAGTGGGCGTACATGCACATC

GCCGGACAGGACGCTTCGGAGTACCTGAGTCCGGGTCTGGTGCAGTTTGCCCGCGCCACAGACACCTACTTCA

GTCTGGGGAACAAGTTTAGGAACCCCACGGTGGCGCCCACGCACGATGTGACCACCGACCGCAGCCAGCGGC

TGACGCTGCGCTTCGTGCCCGTGGACCGCGAGGACAACACCTACTCGTACAAAGTGCGCTACACGCTGGCCG

TGGGCGACAACCGCGTGCTGGACATGGCCAGCACCTACTTTGACATCCGCGGCGTGCTGGATCGGGGCCCTA

GCTTCAAACCCTACTCCGGCACCGCCTACAACAGTCTGGCCCCCAAGGGAGCACCCAACACTTGTCAGTGGA

CATATAAAGCCGATGGTGAAACTGCCACAGAAAAAACCTATACATATGGAAATGCACCCGTGCAGGGCATTA

ACATCACAAAAGATGGTATTCAACTTGGAACTGACACCGATGATCAGCCAATCTACGCAGATAAAACCTATC

AGCCTGAACCTCAAGTGGGTGATGCTGAATGGCATGACATCACTGGTACTGATGAAAAGTATGGAGGCAGAG

CTCTTAAGCCTGATACCAAAATGAAGCCTTGTTATGGTTCTTTTGCCAAGCCTACTAATAAAGAAGGAGGTCA

GGCAAATGTGAAAACAGGAACAGGCACTACTAAAGAATATGACATAGACATGGCTTTCTTTGACAACAGAAG

TGCGGCTGCTGCTGGCCTAGCTCCAGAAATTGTTTTGTATACTGAAAATGTGGATTTGGAAACTCCAGATACC

CATATTGTATACAAAGCAGGCACAGATGACAGCAGCTCTTCTATTAATTTGGGTCAGCAAGCCATGCCCAACA

GACCTAACTACATTGGTTTCAGAGACAACTTTATCGGGCTCATGTACTACAACAGCACTGGCAATATGGGGGT

GCTGGCCGGTCAGGCTTCTCAGCTGAATGCTGTGGTTGACTTGCAAGACAGAAACACCGAGCTGTCCTACCAG

CTCTTGCTTGACTCTCTGGGTGACAGAACCCGGTATTTCAGTATGTGGAATCAGGCGGTGGACAGCTATGATC

CTGATGTGCGCATTATTGAAAATCATGGTGTGGAGGATGAACTTCCCAACTATTGTTTCCCTCTGGATGCTGTT

GGCAGAACAGATACTTATCAGGGAATTAAGGCTAATGGAACTGATCAAACCACATGGACCAAAGATGACAGT

GTCAATGATGCTAATGAGATAGGCAAGGGTAATCCATTCGCCATGGAAATCAACATCCAAGCCAACCTGTGG

AGGAACTTCCTCTACGCCAACGTGGCCCTGTACCTGCCCGACTCTTACAAGTACACGCCGGCCAATGTTACCC

TGCCCACCAACACCAACACCTACGATTACATGAACGGCCGGGTGGTGGCGCCCTCGCTGGTGGACTCCTACAT

CAACATCGGGGCGCTGGTCGCTGGATCCCATGGACAACGTGAACCCCTTCAACCACCACCGCAATGCGGG

GCTGCGCTACCGCTCCATGCTCCTGGGCAACGGGCGCTACGTGCCCTTCCACATCCAGGTGCCCCAGAAATTT

TTCGCCATCAAGAGCCTCCTGCTCCTGCCCGGTCCTACACCTACGAGTGGAACTTCCGCAAGGACGTCAACA

TGATCCTGCAGAGCTCCCTCGGCAACGACCTGCGCACGGACGGGGCCTCCATCTCCTTCACCAGCATCAACCT

CTACGCCACCTTCTTCCCCATGGCGCACAACACGGCCTCCACGCTCGAGGCCATGCTGCGCAACGACACCAAC

GACCAGTCCTTCAACGACTACCTCTCGGCGGCCAACATGCTCTACCCCATCCCGGCCAACGCCACCAACGTGC

CCATCTCCATCCCCTCGCGCAACTGGGCCGCCTTCCGCGGCTGGTCCTTCACGCGTCTCAAGACCAAGGAGAC

GCCCTCGCTGGGCTCCGGGTTCGACCCCTACTTCGTCTACTCGGGCTCCATCCCCTACCTCGACGGCACCTTCT

ACCTCAACCACACCTTCAAGAAGGTCTCCATCACCTTCGACTCCTCCGTCAGCTGGCCCGGCAACGACCGGCT

CCTGACGCCCAACGAGTTCGAAATCAAGCGCACCGTCGACGGCGAGGGCTACAACGTGGCCCAGTGCAACAT
```

-continued

```
GACCAAGGACTGGTTCCTGGTCCAGATGCTGGCCCACTACAACATCGGCTACCAGGGCTTCTACGTGCCCGAG

GGCTACAAGGACCGCATGTACTCCTTCTTCCGCAACTTCCAGCCCATGAGCCGCCAGGTGGTGGACGAGGTCA

ACTACAAGGACTACCAGGCCGTCACCCTGGCCTACCAGCACAACAACTCGGGCTTCGTCGGCTACCTCGCGCC

CACCATGCGCCAGGGCCAGCCCTACCCCGCCAACTACCCCTACCCGCTCATCGGCAAGAGCGCCGTCACCAG

CGTCACCCAGAAAAAGTTCCTCTGCGACAGGGTCATGTGGCGCATCCCCTTCTCCAGCAACTTCATGTCCATG

GGCGCGCTCACCGACCTCGGCCAGAACATGCTCTATGCCAACTCCGCCCACGCGCTAGACATGAATTTCGAA

GTCGACCCCATGGATGAGTCCACCCTTCTCTATGTTGTCTTCGAAGTCTTCGACGTCGTCCGAGTGCACCAGCC

CCACCGCGGCGTCATCGAGGCCGTCTACCTGCGCACCCCCTTCTCGGCCGGTAACGCCACCACCTAAGCTCTT

GCTTCTTGCAAGCCATGGCCGCGGGCTCCGGCGAGCAGGAGCTCAGGGCCATCATCCGCGACCTGGGCTGCG

GGCCCTACTTCCTGGGCACCTTCGATAAGCGCTTCCCGGGATTCATGGCCCCGCACAAGCTGGCCTGCGCCAT

CGTCAACACGGCCGGCCGCGAGACCGGGGGCGAGCACTGGCTGGCCTTCGCCTGGAACCCGCGCTCGAACAC

CTGCTACCTCTTCGACCCCTTCGGGTTCTCGGACGAGCGCCTCAAGCAGATCTACCAGTTCGAGTACGAGGGC

CTGCTGCGCCGCAGCGCCCTGGCCACCGAGGACCGCTGCGTCACCCTGGAAAAGTCCACCCAGACCGTGCAG

GGTCCGCGCTCGGCCGCCTGCGGGCTCTTCTGCTGCATGTTCCTGCACGCCTTCGTGCACTGGCCCGACCGCC

CCATGGACAAGAACCCCACCATGAACTTGCTGACGGGGGTGCCCAACGGCATGCTCCAGTCGCCCCAGGTGG

AACCCACCCTGCGCCGCAACCAGGAGGCGCTCTACCGCTTCCTCAACTCCCACTCCGCCTACTTTCGCTCCCA

CCGCGCGCGCATCGAGAAGGCCACCGCCTTCGACCGCATGAATCAAGACATGTAAACCGTGTGTATGTTA

AATGTCTTTAATAAACAGCACTTTCATGTTACACATGCATCTGAGATGATTTATTTAGAAATCGAAAGGGTTC

TGCCGGGTCTCGGCATGGCCCGCGGGCAGGGACACGTTGCGGAACTGGTACTTGGCCAGCCACTTGAACTCG

GGGATCAGCAGTTTGGGCAGCGGGGTGTCGGGGAAGGAGTCGGTCCACAGCTTCCGCGTCAGTTGCAGGGCG

CCCAGCAGGTCGGGCGCGGAGATCTTGAAATCGCAGTTGGGACCCGCGTTCTGCGCGCGGGAGTTGCGGTAC

ACGGGGTTGCAGCACTGGAACACCATCAGGGCCGGGTGCTTCACGCTCGCCAGCACCGTCGCGTCGGTGATG

CTCTCCACGTCGAGGTCCTCGGCGTTGGCCATCCCGAAGGGGGTCATCTTGCAGGTCTGCCTTCCCATGGTGG

GCACGCACCCGGGCTTGTGGTTGCAATCGCAGTGCAGGGGATCAGCATCATCTGGGCCTGGTCGGCGTTCAT

CCCCGGGTACATGGCCTTCATGAAAGCCTCCAATTGCCTGAACGCCTGCTGGGCCTTGGCTCCTCGGTGAAG

AAGACCCCGCAGGACTTGCTAGAGAACTGGTTGGTGGCGCACCCGGCGTCGTGCACGCAGCAGCGCGCGTCG

TTGTTGGCCAGCTGCACCACGCTGCGCCCCCAGCGGTTCTGGGTGATCTTGGCCCGGTCGGGGTTCTCCTTCA

GCGCGCGCTGCCCGTTCTCGCTCGCCACATCCATCTCGATCATGTGCTCCTTCTGGATCATGGTGGTCCCGTGC

AGGCACCGCAGCTTGCCCTCGGCCTCGGTGCACCCGTGCAGCCACAGCGCGCACCCGGTGCACTCCCAGTTCT

TGTGGGCGATCTGGGAATGCGCGTGCACGAAGCCCTGCAGGAAGCGGCCCATCATGGTGGTCAGGGTCTTGT

TGCTAGTGAAGGTCAGCGGAATGCCGCGGTGCTCCTCGTTGATGTACAGGTGGCAGATCGGCGGTACACCT

CGCCCTGCTCGGGCATCAGCTGGAAGTTGGCTTTCAGGTCGGTCTCCACGCGGTAGCGGTCCATCAGCATAGT

CATGATTTCCATACCCTTCTCCCAGGCCGAGACGATGGGCAGGCTCATAGGGTTCTTCACCATCATCTTAGCG

CTAGCAGCCGCGGCCAGGGGGTCGCTCTCGTCCAGGGTCTCAAAGCTCCGCTTGCCGTCCTTCTCGGTGATCC

GCACCGGGGGGTAGCTGAAGCCCACGGCCGCCAGCTCCTCCTCGGCCTGTCTTTCGTCCTCGCTGTCCTGGCT

GACGTCCTGCAGGACCACATGCTTGGTCTTGCGGGGTTTCTTCTTGGGCGGCAGCGGCGGCGGAGATGTTGGA

GATGGCGAGGGGAGCGCGAGTTCTCGCTCACCACTACTATCTCTTCCTCTTCTTGGTCCGAGGCCACGCGGC

GGTAGGTATGTCTCTTCGGGGGCAGAGGCGGAGGCGACGGGCTCTCGCCGCCGCGACTTGGCGGATGGCTGG

CAGAGCCCCTTCCGCGTTCGGGGGTGCGCTCCCGGCGGCGCTCTGACTGACTTCCTCCGCGGCCGGCCATTGT

GTTCTCCTAGGGAGGAACAACAAGCATGGAGACTCAGCCATCGCCAACCTCGCCATCTGCCCCCACCGCCGA

CGAGAAGCAGCAGCAGCAGAATGAAAGCTTAACCGCCCCGCCGCCCAGCCCCGCCACCTCCGACGCGGCCGT
```

-continued

```
CCCAGACATGCAAGAGATGGAGGAATCCATCGAGATTGACCTGGGCTATGTGACGCCCGCGGAGCACGAGG
AGGAGCTGGCAGTGCGCTTTTCACAAGAAGAGATACACCAAGAACAGCCAGAGCAGGAAGCAGAGAATGAG
CAGAGTCAGGCTGGGCTCGAGCATGACGGCGACTACCTCCACCTGAGCGGGGGGGAGGACGCGCTCATCAAG
CATCTGGCCCGGCAGGCCACCATCGTCAAGGATGCGCTGCTCGACCGCACCGAGGTGCCCCTCAGCGTGGAG
GAGCTCAGCCGCGCCTACGAGTTGAACCTCTTCTCGCCGCGCGTGCCCCCCAAGCGCCAGCCCAATGGCACCT
GCGAGCCCAACCCGCGCCTCAACTTCTACCCGGTCTTCGCGGTGCCCGAGGCCCTGGCCACCTACCACATCTT
TTTCAAGAACCAAAAGATCCCCGTCTCCTGCCGCGCCAACCGCACCCGCGCCGACGCCCTTTTCAACCTGGGT
CCCGGCGCCCGCCTACCTGATATCGCCTCCTTGGAAGAGGTTCCCAAGATCTTCGAGGGTCTGGGCAGCGACG
AGACTCGGGCCGCGAACGCTCTGCAAGGAGAAGGAGGAGAGCATGAGCACCACAGCGCCCTGGTCGAGTTG
GAAGGCGACAACGCGCGGCTGGCGGTGCTCAAACGCACGGTCGAGCTGACCCATTTCGCCTACCCGGCTCTG
AACCTGCCCCCCAAAGTCATGAGCGCGGTCATGGACCAGGTGCTCATCAAGCGCGCGTCGCCCATCTCCGAG
GACGAGGGCATGCAAGACTCCGAGGAGGGCAAGCCCGTGGTCAGCGACGAGCAGCTGGCCCGGTGGCTGGG
TCCTAATGCTAGTCCCCAGAGTTTGGAAGAGCGGCGCAAACTCATGATGGCCGTGGTCCTGGTGACCGTGGA
GCTGGAGTGCCTGCGCCGCTTCTTCGCCGACGCGGAGACCCTGCGCAAGGTCGAGGAGAACCTGCACTACCT
CTTCAGGCACGGGTTCGTGCGCCAGGCCTGCAAGATCTCCAACGTGGAGCTGACCAACCTGGTCTCCTACATG
GGCATCTTGCACGAGAACCGCTGGGGCAGAACGTGCTGCACACCACCCTGCGCGGGGAGGCCCGGCGCGAC
TACATCCGCGACTGCGTCTACCTCTACCTCTGCCACACCTGGCAGACGGGCATGGGCGTGTGGCAGCAGTGTC
TGGAGGAGCAGAACCTGAAAGAGCTCTGCAAGCTCCTGCAGAAGAACCTCAAGGGTCTGTGGACCGGGTTCG
ACGAGCGCACCACCGCCTCGGACCTGGCCGACCTCATTTTCCCCGAGCGCCTCAGGCTGACGCTGCGCAACG
GCCTGCCCGACTTTATGAGCCAAAGCATGTTGCAAAACTTTCGCTCTTTCATCCTCGAACGCTCCGGAATCCT
GCCCGCCACCTGCTCCGCGCTGCCCTCGGACTTCGTGCCGCTGACCTTCCGCGAGTGCCCCCCGCCGCTGTGG
AGCCACTGCTACCTGCTGCGCCTGGCCAACTACCTGGCCTACCACTCGGACGTGATCGAGGACGTCAGCGGC
GAGGGCCTGCTCGAGTGCCACTGCCGCTGCAACCTCTGCACGCCGCACCGCTCCCTGGCCTGCAACCCCCAGC
TGCTGAGCGAGACCCAGATCATCGGCACCTTCGAGTTGCAAGGGCCCAGCGAAGGCGAGGGTTCAGCCGCCA
AGGGGGGTCTGAAACTCACCCCGGGGCTGTGGACCTCGGCCTACTTGCGCAAGTTCGTGCCCGAGGACTACC
ATCCCTTCGAGATCAGGTTCTACGAGGACCAATCCCATCCGCCCAAGGCCGAGCTGTCGGCCTGCGTCATCAC
CCAGGGGGCGATCCTGGCCCAATTGCAAGCCATCCAGAAATCCCGCCAAGAATTCTTGCTGAAAAAGGGCCG
CGGGGTCTACCTCGACCCCCAGACCGGTGAGGAGCTCAACCCCGGCTTCCCCCAGGATGCCCCGAGGAAACA
AGAAGCTGAAAGTGGAGCTGCCGCCCGTGGAGGATTTGGAGGAAGACTGGGAGAACAGCAGTCAGGCAGAG
GAGGAGGAGATGGAGGAAGACTGGACAGCACTCAGGCAGAGGAGGACAGCCTGCAAGACAGTCTGGAGG
AAGACGAGGAGGAGGCAGAGGAGGAGGTGGAAGAAGCAGCCGCCGCCAGACCGTCGTCCTCGGCGGGGA
GAAAGCAAGCAGCACGGATACCATCTCCGCTCCGGGTCGGGGTCCCGCTCGACCACACAGTAGATGGGACGA
GACCGGACGATTCCCGAACCCCACCACCCAGACCGGTAAGAAGGAGCGGCAGGGATACAAGTCCTGGCGGG
GGCACAAAAACGCCATCGTCTCCTGCTTGCAGGCCTGCGGGGCAACATCTCCTTCACCCGGCGCTACCTGCT
CTTCCACCGCGGGGTGAACTTTCCCCGCAACATCTTGCATTACTACCGTCACCTCCACAGCCCCTACTACTTCC
AAGAAGAGGCAGCAGCAGCAGAAAAAGACCAGCAGAAAACCAGCAGCTAGAAAATCCACAGCGGCGGCAG
CAGGTGGACTGAGGATCGCGGCGAACGAGCCGGCGCAAACCCGGGAGCTGAGGAACCGGATCTTTCCCACCC
TCTATGCCATCTTCCAGCAGAGTCGGGGGCAGGAGCAGGAACTGAAAGTCAAGAACCGTTCTCTGCGCTCGC
TCACCCGCAGTTGTCTGTATCACAAGAGCGAAGACCAACTTCAGCGCACTCTCGAGGACGCCGAGGCTCTCTT
CAACAAGTACTGCGCGCTCACTCTTAAAGAGTAGCCCGCGCCCGCCCAGTCGCAGAAAAAGGCGGGAATTAC
```

-continued
GTCACCTGTGCCCTTCGCCCTAGCCGCCTCCACCCATCATCATGAGCAAAGAGATTCCCACGCCTTACATGTG

GAGCTACCAGCCCCAGATGGGCCTGGCCGCCGGTGCCGCCCAGGACTACTCCACCCGCATGAATTGGCTCAG

CGCCGGGCCCGCGATGATCTCACGGGTGAATGACATCCGCGCCCACCGAAACCAGATACTCCTAGAACAGTC

AGCGCTCACCGCCACGCCCCGCAATCACCTCAATCCGCGTAATTGGCCCGCCGCCCTGGTGTACCAGGAAATT

CCCCAGCCCACGACCGTACTACTTCCGCGAGACGCCCAGGCCGAAGTCCAGCTGACTAACTCAGGTGTCCAG

CTGGCGGGCGGCGCCACCCTGTGTCGTCACCGCCCCGCTCAGGGTATAAAGCGGCTGGTGATCCGGGGCAGA

GGCACACAGCTCAACGACGAGGTGGTGAGCTCTTCGCTGGGTCTGCGACCTGACGGAGTCTTCCAACTCGCC

GGATCGGGGAGATCTTCCTTCACGCCTCGTCAGGCCGTCCTGACTTTGGAGAGTTCGTCCTCGCAGCCCGCT

CGGGTGGCATCGGCACTCTCCAGTTCGTGGAGGAGTTCACTCCCTCGGTCTACTTCAACCCCTTCTCCGGCTCC

CCCGGCCACTACCCGGACGAGTTCATCCCGAACTTCGACGCCATCAGCGAGTCGGTGGACGGCTACGATTGA

AACTAATCACCCCCTTATCCAGTGAAATAAAGATCATATTGATGATGATTTTACAGAAATAAAAAATAATCAT

TTGATTTGAAATAAAGATACAATCATATTGATGATTTGAGTTTAACAAAAAATAAAGAATCACTTACTTGAA

ATCTGATACCAGGTCTCTGTCCATGTTTTCTGCCAACACCACTTCACTCCCCTCTTCCCAGCTCTGGTACTGCA

GGCCCCGGCGGGCTGCAAACTTCCTCCACACGCTGAAGGGGATGTCAAATTCCTCCTGTCCCTCAATCTTCAT

TTTATCTTCTATCAGATGTCCAAAAAGCGCGTCCGGGTGGATGATGACTTCGACCCCGTCTACCCCTACGATG

CAGACAACGCACCGACCGTGCCCTTCATCAACCCCCCCTTCGTCTCTTCAGATGGATTCCAAGAGAAGCCCCT

GGGGGTGTTGTCCCTGCGACTGGCCGACCCCGTCACCACCAAGAACGGGGAAATCACCCTCAAGCTGGGAGA

GGGGGTGGACCTCGATTCCTCGGGAAAACTCATCTCCAACACGGCCACCAAGGCCGCCGCCCCTCTCAGTTTT

TCCAACAACACCATTTCCCTTAACATGGATCACCCCTTTTACACTAAAGATGGAAAATTATCCTTACAAGTTTC

TCCACCATTAAATATACTGAGAACAAGCATTCTAAACACACTAGCTTTAGGTTTTGGATCAGGTTTAGGACTC

CGTGGCTCTGCCTTGGCAGTACAGTTAGTCTCTCCACTTACATTTGATACTGATGGAAACATAAAGCTTACCTT

AGACAGAGGTTTGCATGTTACAACAGGAGATGCAATTGAAAGCAACATAAGCTGGGCTAAAGGTTTAAAATT

TGAAGATGGAGCCATAGCAACCAACATTGGAAATGGGTTAGAGTTTGGAAGCAGTAGTACAGAAACAGGTGT

TGATGATGCTTACCCAATCCAAGTTAAACTTGGATCTGGCCTTAGCTTTGACAGTACAGGAGCCATAATGGCT

GGTAACAAAGAAGACGATAAACTCACTTTGTGGACAACACCTGATCCATCACCAAACTGTCAAATACTCGCA

GAAAATGATGCAAAACTAACACTTTGCTTGACTAAATGTGGTAGTCAAATACTGGCCACTGTGTCAGTCTTAG

TTGTAGGAAGTGGAAACCTAAACCCCATTACTGGCACCGTAAGCAGTGCTCAGGTGTTTCTACGTTTTGATGC

AAACGGTGTTCTTTTAACAGAACATTCTACACTAAAAAAATACTGGGGGTATAGGCAGGGAGATAGCATAGA

TGGCACTCCATATACCAATGCTGTAGGATTCATGCCCAATTTAAAAGCTTATCCAAAGTCACAAAGTTCTACT

ACTAAAAATAATATAGTAGGGCAAGTATACATGAATGGAGATGTTTCAAAACCTATGCTTCTCACTATAACCC

TCAATGGTACTGATGACAGCAACAGTACATATTCAATGTCATTTTCATACACCTGGACTAATGGAAGCTATGT

TGGAGCAACATTTGGGCTAACTCTTATACCTTCTCATACATCGCCCAAGAATGAACACTGTATCCCACCCTG

CATGCCAACCCTTCCCACCCCACTCTGTGGAACAAACTCTGAAACACAAAATAAAATAAAGTTCAAGTGTTTT

ATTGATTCAACAGTTTTACAGGATTCGAGCAGTTATTTTTCCTCCACCCTCCCAGGACATGGAATACACCACC

CTCTCCCCCCGCACAGCCTTGAACATCTGAATGCCATTGGTGATGGACATGCTTTTGGTCTCCACGTTCCACAC

AGTTTCAGAGCGAGCCAGTCTCGGGTCGGTCAGGGAGATGAAACCCTCCGGGCACTCCCGCATCTGCACCTC

ACAGCTCAACAGCTGAGGATTGTCCTCGGTGGTCGGGATCACGGTTATCTGGAAGAAGCAGAAGAGCGGCGG

TGGGAATCATAGTCCGCGAACGGGATCGGCCGGTGGTGTCGCATCAGGCCCCGCAGCAGTCGCTGCCGCCGC

CGCTCCGTCAAGCTGCTGCTCAGGGGGTCCGGGTCCAGGGACTCCCTCAGCATGATGCCCACGGCCCTCAGCA

TCAGTCGTCTGGTGCGGCGGGCGCAGCAGCGCATGCGGATCTCGCTCAGGTCGCTGCAGTACGTGCAACACA

GAACCACCAGGTTGTTCAACAGTCCATAGTTCAACACGCTCCAGCCGAAACTCATCGCGGGAAGGATGCTAC

-continued

CCACGTGGCCGTCGTACCAGATCCTCAGGTAAATCAAGTGGTGCCCCCTCCAGAACACGCTGCCCACGTACAT

GATCTCCTTGGGCATGTGGCGGTTCACCACCTCCCGGTACCACATCACCCTCTGGTTGAACATGCAGCCCCGG

ATGATCCTGCGGAACCACAGGGCCAGCACCGCCCCGCCCGCCATGCAGCGAAGAGACCCCGGGTCCCGGCAA

TGGCAATGGAGGACCCACCGCTCGTACCCGTGGATCATCTGGGAGCTGAACAAGTCTATGTTGGCACAGCAC

AGGCATATGCTCATGCATCTCTTCAGCACTCTCAACTCCTCGGGGGTCAAAACCATATCCCAGGGCACGGGGA

ACTCTTGCAGGACAGCGAACCCCGCAGAACAGGGCAATCCTCGCACAGAACTTACATTGTGCATGGACAGGG

TATCGCAATCAGGCAGCACCGGGTGATCCTCCACCAGAGAAGCGCGGGTCTCGGTCTCCTCACAGCGTGGTA

AGGGGGCCGGCCGATACGGGTGATGGCGGGACGCGGCTGATCGTGTTCGCGACCGTGTCATGATGCAGTTGC

TTTCGGACATTTTCGTACTTGCTGTAGCAGAACCTGGTCCGGGCGCTGCACACCGATCGCCGGCGGCGGTCTC

GGCGCTTGGAACGCTCGGTGTTGAAATTGTAAAACAGCCACTCTCTCAGACCGTGCAGCAGATCTAGGGCCTC

AGGAGTGATGAAGATCCCATCATGCCTGATGGCTCTGATCACATCGACCACCGTGGAATGGGCCAGACCCAG

CCAGATGATGCAATTTTGTTGGGTTTCGGTGACGGCGAGCCTCGGGAACAACGATGAAGTAAATGCAAGCGG

TGCGTTCCAGCATGGTTAGTTAGCTGATCTGTAGAAAAAACAAAAATGAACATTAAACCATGCTAGCCTGGC

GAACAGGTGGGTAAATCGTTCTCTCCAGCACCAGGCAGGCCACGGGGTCTCCGGCGCGACCCTCGTAAAAAT

TGTCGCTATGATTGAAAACCATCACAGAGAGACGTTCCCGGTGGCCGGCGTGAATGATTCGACAAGATGAAT

ACACCCCCGGAACATTGGCGTCCGCGAGTGAAAAAAAGCGCCCGAGGAAGCAATAAGGCACTACAATGCTC

AGTCTCAAGTCCAGCAAAGCGATGCCATGCGGATGAAGCACAAAATTCTCAGGTGCGTACAAAATGTAATTA

CTCCCCTCCTGCACAGGCAGCAAAGCCCCCGATCCCTCCAGGTACACATACAAAGCCTCAGCGTCCATAGCTT

ACCGAGCAGCAGCACACAACAGGCGCAAGAGTCAGAGAAAGGCTGAGCTCTAACCTGTCCACCCGCTCTCTG

CTCAATATATAGCCCAGATCTACACTGACGTAAAGGCCAAAGTCTAAAAATACCCGCCAAATAATCACACAC

GCCCAGCACACGCCCAGAAACCGGTGACACACTCAAAAAAATACGCGCACTTCCTCAAACGCCCAAAACTGC

CGTCATTTCCGGGTTCCCACGCTACGTCATCAAAACACGACTTTCAAATTCCGTCGACCGTTAAAAACGTCAC

CCGCCCCGCCCCTAACGGTCGCCCGTCTCTCAGCCAATCAGCGCCCCGCATCCCCAAATTCAAACACCTCATT

TGCATATTAACGCGCACAAAAAGTTTGAGGTATATTATTGATGATG

ChAdV68-GFP-E4deleted (SEQ ID NO: 58); Bold italicized = GFP transgene
CATCaTCAATAATATACCTCAAACTTTTTGTGCGCGTTAATATGCAAATGAGGCGTTTGAATTTGGGGAGGAA

GGGCGGTGATTGGTCGAGGGATGAGCGACCGTTAGGGGCGGGGCGAGTGACGTTTTGATGACGTGGTTGCGA

GGAGGAGCCAGTTTGCAAGTTCTCGTGGGAAAAGTGACGTCAAACGAGGTGTGGTTTGAACACGGAAATACT

CAATTTTCCCGCGCTCTCTGACAGGAAATGAGGTGTTTCTGGGCGGATGCAAGTGAAAACGGGCCATTTTCGC

GCGAAAACTGAATGAGGAAGTGAAAATCTGAGTAATTTCGCGTTTATGGCAGGGAGGAGTATTTGCCGAGGG

CCGAGTAGACTTTGACCGATTACGTGGGGGTTTCGATTACCGTGTTTTTCACCTAAATTTCCGCGTACGGTGTC

AAAGTCCGGTGTTTTTACGTAGGTGTCAGCTGATCGCCAGGGTATTTAAACCTGCGCTCTCCAGTCAAGAGGC

CACTCTTGAGTGCCAGCGAGAAGAGTTTTCTCCTCCGCGCCGCGAGTCAGATCTACACTTTGAAAGTAGGGAT

AACAGGGTAATgacattgattattgactagttGttaaTAGTAATCAATTACGGGGTCATTAGTTCATAGCCCATATAT

GGAGTTCCGCGTTACATAACTTACGGTAAATGGCCCGCCTGGCTGACCGCCCAACGACCCCCGCCCATTGACGTCAATA

ATGACGTATGTTCCCATAGTAACGCCAATAGGGACTTTCCATTGACGTCAATGGGTGGAGTATTTACGGTAAA

CTGCCCACTTGGCAGTACATCAAGTGTATCATATGCCAAGTCCGCCCCCTATTGACGTCAATGACGGTAAATG

GCCCGCCTGGCATTATGCCCAGTACATGACCTTACGGGACTTTCCTACTTGGCAGTACATCTACGTATTAGTC

ATCGCTATTACCATGgTGATGCGGTTTTGGCAGTACACCAATGGGCGTGGATAGCGGTTTGACTCACGGGGAT

TTCCAAGTCTCCACCCCATTGACGTCAATGGGAGTTTGTTTTGGCACCAAAATCAACGGGACTTTCCAAAATG

TCGTAATAACCCCGCCCCGTTGACGCAAATGGGCGGTAGGCGTGTACGGTGGGAGGTCTATATAAGCAGAgcT

-continued

CGTTTAGTGAACCGTCAGATCGCCTGGAACGCCATCCACGCTGTTTTGACCTCCATAGAAGACAGCGATCGCG ccacc

ATGGTGAGCAAGGGCGAGGAGCTGTTCACCGGGGTGGTGCCCATCCTGGTCGAGCTGGACGGCGACGTAAACG

GCCACAAGTTCAGCGTGTCCGGCGAGGGCGAGGGCGATGCCACCTACGGCAAGCTGACCCTGAAGTTCATCTG

CACCACCGGCAAGCTGCCCGTGCCCTGGCCCACCCTCGTGACCACCCTGACCTACGGCGTGCAGTGCTTCAGCC

GCTACCCCGACCACATGAAGCAGCACGACTTCTTCAAGTCCGCCATGCCCGAAGGCTACGTCCAGGAGCGCACC

ATCTTCTTCAAGGACGACGGCAACTACAAGACCCGCGCCGAGGTGAAGTTCGAGGGCGACACCCTGGTGAACC

GCATCGAGCTGAAGGGCATCGACTTCAAGGAGGACGGCAACATCCTGGGGCACAAGCTGGAGTACAACTACAA

CAGCCACAACGTCTATATCATGGCCGACAAGCAGAAGAACGGCATCAAGGTGAACTTCAAGATCCGCCACAACA

TCGAGGACGGCAGCGTGCAGCTCGCCGACCACTACCAGCAGAACACCCCCATCGGCGACGGCCCCGTGCTGCT

GCCGACAACCACTACCTGAGCACCCAGTCCGCCCTGAGCAAAGACCCCAAGGAGAAGCGCGATCACATGGTCC

TGCTGGAGTTCGTGACCGCCGCCGGGATCACTCTCGGCATGGACGAGCTtTACAAGTAG tgaGTTTAAACTCCCATTTAAATGTGAGGGTTAATGCTTCGAGCAGACATGATAAGATACATTGATGAGTTTGG

ACAAACCACAACTAGAATGCAGTGAAAAAAATGCTTTATTTGTGAAATTTGTGATGCTATTGCTTTATTTGTA

ACCATTATAAGCTGCAATAAACAAGTTAACAACAACAATTGCATTCATTTTATGTTTCAGGTTCAGGGGGAGA

TGTGGGAGGTTTTTTAAAGCAAGTAAAACCTCTACAAATGTGGTAAAATAACTATAACGGTCCTAAGGTAGC

GAGTGAGTAGTGTTCTGGGCGGGGGAGGACCTGCATGAGGGCCAGAATAACTGAAATCTGTGCTTTTCTGT

GTGTTGCAGCAGCATGAGCGGAAGCGGCTCCTTTGAGGGAGGGGTATTCAGCCCTTATCTGACGGGGCGTCT

CCCCTCCTGGGCGGGAGTGCGTCAGAATGTGATGGGATCCACGGTGGACGGCCGGCCCGTGCAGCCCGCGAA

CTCTTCAACCCTGACCTATGCAACCCTGAGCTCTTCGTCGTTGGACGCAGCTGCCGCCGCAGCTGCTGCATCT

GCCGCCAGCGCCGTGCGCGGAATGGCCATGGGCGCCGGCTACTACGGCACTCTGGTGGCCAACTCGAGTTCC

ACCAATAATCCCGCCAGCCTGAACGAGGAGAAGCTGTTGCTGCTGATGGCCCAGCTCGAGGCCTTGACCCAG

CGCCTGGGCGAGCTGACCCAGCAGGTGGCTCAGCTGCAGGAGCAGACGCGGGCCGCGGTTGCCACGGTGAA

ATCCAAATAAAAAATGAATCAATAAATAAACGGAGACGGTTGTTGATTTTAACACAGAGTCTGAATCTTTATT

TGATTTTTCGCGCGCGGTAGGCCCTGGACCACCGGTCTCGATCATTGAGCACCCGGTGGATCTTTTCCAGGAC

CCGGTAGAGGTGGGCTTGGATGTTGAGGTACATGGGCATGAGCCCGTCCCGGGGGTGGAGGTAGCTCCATTG

CAGGGCCTCGTGCTCGGGGGTGGTGTTGTAAATCACCCAGTCATAGCAGGGGCGCAGGGCATGGTGTTGCAC

AATATCTTTGAGGAGGAGACTGATGGCCACGGGCAGCCCTTTGGTGTAGGTGTTTACAAATCTGTTGAGCTGG

GAGGGATGCATGCGGGGGAGATGAGGTGCATCTTGGCCTGGATCTTGAGATTGGCGATGTTACCGCCCAGA

TCCCGCCTGGGGTTCATGTTGTGCAGGACCACCAGCACGGTGTATCCGGTGCACTTGGGGAATTTATCATGCA

ACTTGGAAGGGAAGGCGTGAAAGAATTTGGCGACGCCTTTGTGCCCGCCCAGGTTTTCCATGCACTCATCCAT

GATGATGGCGATGGGCCCGTGGGCGGCGGCCTGGGCAAAGACGTTTCGGGGGTCGGACACATCATAGTTGTG

GTCCTGGGTGAGGTCATCATAGGCCATTTTAATGAATTTGGGCGGAGGGTGCCGGACTGGGGGACAAAGGTt

CCCTCGATCCCGGGGGCGTAGTTCCCCTCACAGATCTGCATCTCCCAGGCTTTGAGCTCGGAGGGGGGATCA

TGTCCACCTGCGGGGCGATAAAGAACACGGTTTCCGGGGCGGGGAGATGAGCTGGGCCGAAAGCAAGTTCC

GGAGCAGCTGGGACTTGCCGCAGCCGGTGGGGCCGTAGATGACCCCGATGACCGGCTGCAGGTGGTAGTTGA

GGGAGAGACAGCTGCCGTCCTCCCGGAGGAGGGGGCCACCTCGTTCATCATCTCGCGCACGTGCATGTTCTC

GCGCACCAGTTCCGCCAGGAGGCGCTCTCCCCCCAGGGATAGGAGCTCCTGGAGCGAGGCGAAGTTTTTCAG

CGGCTTGAGTCCGTCGGCCATGGGCATTTTGGAGAGGGTTTGTTGCAAGAGTTCCAGGCGGTCCCAGAGCTCG

GTGATGTGCTCTACGGCATCTCGATCCAGCAGACCTCCTCGTTTCGCGGGTTGGGACGGCTGCGGGAGTAGGG

-continued

```
CACCAGACGATGGGCGTCCAGCGCAGCCAGGGTCCGGTCCTTCCAGGGTCGCAGCGTCCGCGTCAGGGTGGT
CTCCGTCACGGTGAAGGGGTGCGCGCCGGGCTGGGCGCTTGCGAGGGTGCGCTTCAGGCTCATCCGGCTGGT
CGAAAACCGCTCCCGATCGGCGCCCTGCGCGTCGGCCAGGTAGCAATTGACCATGAGTTCGTAGTTGAGCGC
CTCGGCCGCGTGGCCTTTGGCGCGGAGCTTACCTTTGGAAGTCTGCCCGCAGGCGGGACAGAGGAGGGACTT
GAGGGCGTAGAGCTTGGGGGCGAGGAAGACGGACTCGGGGGCGTAGGCGTCCGCGCCGCAGTGGGCGCAGA
CGGTCTCGCACTCCACGAGCCAGGTGAGGTCGGGCTGGTCGGGGTCAAAAACCAGTTTCCCGCCGTTCTTTTT
GATGCGTTTCTTACCTTTGGTCTCCATGAGCTCGTGTCCCCGCTGGGTGACAAAGAGGCTGTCCGTGTCCCCGT
AGACCGACTTTATGGGCCGGTCCTCGAGCGGTGTGCCGCGGTCCTCCTCGTAGAGGAACCCCGCCCACTCCGA
GACGAAAGCCCGGGTCCAGGCCAGCACGAAGGAGGCCACGTGGGACGGGTAGCGGTCGTTGTCCACCAGCG
GGTCCACCTTTTCCAGGGTATGCAAACACATGTCCCCCTCGTCCACATCCAGGAAGGTGATTGGCTTGTAAGT
GTAGGCCACGTGACCGGGGGTCCCGGCCGGGGGGGTATAAAAGGGTGCGGGTCCCTGCTCGTCCTCACTGTC
TTCCGGATCGCTGTCCAGGAGCGCCAGCTGTTGGGGTAGGTATTCCCTCTCGAAGGCGGGCATGACCTCGGCA
CTCAGGTTGTCAGTTTCTAGAAACGAGGAGGATTTGATATTGACGGTGCCGGCGGAGATGCCTTTCAAGAGCC
CCTCGTCCATCTGGTCAGAAAAGACGATCTTTTTGTTGTCGAGCTTGGTGGCGAAGGAGCCGTAGAGGGCGTT
GGAGAGGAGCTTGGCGATGGAGCGCATGGTCTGGTTTTTTTCCTTGTCGGCGCGCTCCTTGGCGGCGATGTTG
AGCTGCACGTACTCGCGCGCCACGCACTTCCATTCGGGGAAGACGGTGGTCAGCTCGTCGGGCACGATTCTG
ACCTGCCAGCCCCGATTATGCAGGGTGATGAGGTCCACACTGGTGGCCACCTCGCCGCGCAGGGGCTCATTA
GTCCAGCAGAGGCGTCCGCCCTTGCGCGAGCAGAAGGGGGCAGGGGGTCCAGCATGACCTCGTCGGGGGG
GTCGGCATCGATGGTGAAGATGCCGGGCAGGAGGTCGGGGTCAAAGTAGCTGATGGAAGTGGCCAGATCGTC
CAGGGCAGCTTGCCATTCGCGCACGGCCAGCGCGCGCTCGTAGGGACTGAGGGGCGTGCCCCAGGGCATGGG
ATGGGTAAGCGCGGAGGCGTACATGCCGCAGATGTCGTAGACGTAGAGGGGCTCCTCGAGGATGCCGATGTA
GGTGGGGTAGCAGCGCCCCCCGCGGATGCTGGCGCGCACGTAGTCATACAGCTCGTGCGAGGGGCGAGGA
GCCCCGGGCCCAGGTTGGTGCGACTGGGCTTTTCGGCGCGGTAGACGATCTGGCGGAAAATGGCATGCGAGT
TGGAGGAGATGGTGGGCCTTTGGAAGATGTTGAAGTGGGCGTGGGCAGTCCGACCGAGTCGCGGATGAAGT
GGGCGTAGGAGTCTTGCAGCTTGGCGACGAGCTCGGCGGTGACTAGGACGTCCAGAGCGCAGTAGTCGAGGG
TCTCCTGGATGATGTCATACTTGAGCTGTCCCTTTTGTTTCCACAGCTCGCGGTTGAGAAGGAACTCTTCGCGG
TCCTTCCAGTACTCTTCGAGGGGGAACCCGTCCTGATCTGCACGGTAAGAGCCTAGCATGTAGAACTGGTTGA
CGGCCTTGTAGGCGCAGCAGCCCTTCTCCACGGGGAGGGCGTAGGCCTGGGCGGCCTTGCGCAGGGAGGTGT
GCGTGAGGGCGAAAGTGTCCCTGACCATGACCTTGAGGAACTGGTGCTTGAAGTCGATATCGTCGCAGCCCC
CCTGCTCCCAGAGCTGGAAGTCCGTGCGCTTCTTGTAGGCGGGGTTGGGCAAAGCGAAAGTAACATCGTTGA
AGAGGATCTTGCCCGCGCGGGGCATAAAGTTGCGAGTGATGCGGAAAGGTTGGGGCACCTCGGCCCGGTTGT
TGATGACCTGGGCGGCGAGCACGATCTCGTCGAAGCCGTTGATGTTGTGGCCCACGATGTAGAGTTCCACGA
ATCGCGGACGGCCCTTGACGTGGGCAGTTTCTTGAGCTCCTCGTAGGTGAGCTCGTCGGGGTCGCTGAGCCC
GTGCTGCTCGAGCGCCCAGTCGGCGAGATGGGGGTTGGCGCGGAGGAAGGAAGTCCAGAGATCCACGGCCA
GGGCGGTTTGCAGACGGTCCCGGTACTGACGGAACTGCTGCCCGACGGCCATTTTTTCGGGGGTGACGCAGT
AGAAGGTGCGGGGTCCCCGTGCCAGCGATCCCATTTGAGCTGGAGGGCGAGATCGAGGGCGAGCTCGACG
AGCCGGTCGTCCCCGGAGAGTTTCATGACCAGCATGAAGGGGACGAGCTGCTTGCCGAAGGACCCCATCCAG
GTGTAGGTTTCCACATCGTAGGTGAGGAAGAGCCTTTCGGTGCGAGGATGCGAGCCGATGGGGAAGAACTGG
ATCTCCTGCCACCAATTGGAGGAATGGCTGTTGATGTGATGGAAGTAGAAATGCCGACGGCGCGCCGAACAC
TCGTGCTTGTGTTTATACAAGCGGCCACAGTGCTCGCAACGCTGCACGGGATGCACGTGCTGCACGAGCTGTA
CCTGAGTTCCTTTGACGAGGAATTTCAGTGGGAAGTGGAGTCGTGGCGCCTGCATCTCGTGCTGTACTACGTC
```

-continued

```
GTGGTGGTCGGCCTGGCCCTCTTCTGCCTCGATGGTGGTCATGCTGACGAGCCCGCGCGGGAGGCAGGTCCAG

ACCTCGGCGCGAGCGGGTCGGAGAGCGAGGACGAGGGCGCGCAGGCCGGAGCTGTCCAGGGTCCTGAGACG

CTGCGGAGTCAGGTCAGTGGGCAGCGGCGGCGCGCGGTTGACTTGCAGGAGTTTTTCCAGGGCGCGCGGGAG

GTCCAGATGGTACTTGATCTCCACCGCGCCATTGGTGGCGACGTCGATGGCTTGCAGGGTCCCGTGCCCCTGG

GGTGTGACCACCGTCCCCCGTTTCTTCTTGGGCGGCTGGGGCGACGGGGCGGTGCCTCTTCCATGGTTAGAA

GCGGCGGCGAGGACGCGCGCCGGGCGGCAGGGGCGGCTCGGGGCCCGGAGGCAGGGGCGGCAGGGGCACG

TCGGCGCCGCGCGGGTAGGTTCTGGTACTGCGCCCGGAGAAGACTGGCGTGAGCGACGACGCGACGGTTG

ACGTCCTGGATCTGACGCCTCTGGGTGAAGGCCACGGGACCCGTGAGTTTGAACCTGAAAGAGAGTTCGACA

GAATCAATCTCGGTATCGTTGACGGCGGCCTGCCGCAGGATCTCTTGCACGTCGCCCGAGTTGTCCTGGTAGG

CGATCTCGGTCATGAACTGCTCGATCTCCTCCTCTTGAAGGTCTCCGCGGCCGGCGCGCTCCACGGTGGCCGC

GAGGTCGTTGGAGATGCGGCCCATGAGCTGCGAGAAGGCGTTCATGCCCGCCTCGTTCCAGACGCGGCTGTA

GACCACGACGCCCTCGGGATCGCgGGCGCGCATGACCACCTGGGCGAGGTTGAGCTCCACGTGGCGCGTGAA

GACCGCGTAGTTGCAGAGGCGCTGGTAGAGGTAGTTGAGCGTGGTGGCGATGTGCTCGGTGACGAAGAAATA

CATGATCCAGCGGCGGAGCGGCATCTCGCTGACGTCGCCCAGCGCCTCCAAACGTTCCATGGCCTCGTAAAA

GTCCACGGCGAAGTTGAAAAACTGGGAGTTGCGCGCCGAGACGGTCAACTCCTCCTCCAGAAGACGGATGAG

CTCGGCGATGGTGGCGCGCACCTCGCGCTCGAAGGCCCCCGGGAGTTCCTCCACTTCCTCTTCTTCCTCCTCCA

CTAACATCTCTTCTACTTCCTCCTCAGGCGGCAGTGGTGGCGGGGAGGGGCCTGCGTCGCCGGCGGCGCAC

GGGCAGACGGTCGATGAAGCGCTCGATGGTCTCGCCGCGCCGGCGTCGCATGGTCTCGGTGACGGCGCGCCC

GTCCTCGCGGGCCGCAGCGTGAAGACGCCGCCGCGCATCTCCAGGTGGCCGGGGGGTCCCGTTGGGCAG

GGAGAGGGCGCTGACGATGCATCTTATCAATTGCCCCGTAGGGACTCCGCGCAAGGACCTGAGCGTCTCGAG

ATCCACGGGATCTGAAAACCGCTGAACGAAGGCTTCGAGCCAGTCGCAGTCGCAAGGTAGGCTGAGCACGGT

TTCTTCTGGCGGGTCATGTTGGTTGGGAGCGGGGCGGGCGATGCTGCTGGTGATGAAGTTGAAATAGGCGGTT

CTGAGACGGCGGATGGTGGCGAGGAGCACCAGGTCTTTGGGCCCGGCTTGCTGGATGCGCAGACGGTCGGCC

ATGCCCCAGGCGTGGTCCTGACACCTGGCCAGGTCCTTGTAGTAGTCCTGCATGAGCCGCTCCACGGGCACCT

CCTCCTCGCCCGCGCGGCCGTGCATGCGCGTGAGCCCGAAGCCGCGCTGGGGCTGGACGAGCGCCAGGTCGG

CGACGACGCGCTCGGCGAGGATGGCTTGCTGGATCTGGGTGAGGGTGGTCTGGAAGTCATCAAAGTCGACGA

AGCGGTGGTAGGCTCCGGTGTTGATGGTGTAGGAGCAGTTGGCCATGACGGACCAGTTGACGGTCTGGTGGC

CCGGACGCACGAGCTCGTGGTACTTGAGGCGCGAGTAGGCGCGCGTGTCGAAGATGTAGTCGTTGCAGGTGC

GCACCAGGTACTGGTAGCCGATGAGGAAGTGCGGCGGCGGCTGGCGGTAGAGCGGCCATCGCTCGGTGGCG

GGGGCGCCGGGCGCGAGGTCCTCGAGCATGGTGCGGTGGTAGCCGTAGATGTACCTGGACATCCAGGTGATG

CCGGCGGCGGTGGTGGAGGCGCGCGGGAACTCGCGGACGCGGTTCCAGATGTTGCGCAGCGGCAGGAAGTA

GTTCATGGTGGGCACGGTCTGGCCCGTGAGGCGCGCGCAGTCGTGGATGCTCTATACGGGCAAAAACGAAAG

CGGTCAGCGGCTCGACTCCGTGGCCTGGAGGCTAAGCGAACGGGTTGGGCTGCGCGTGTACCCCGGTTCGAA

TCTCGAATCAGGCTGGAGCCGCAGCTAACGTGGTATTGGCACTCCCGTCTCGACCCAAGCCTGCACCAACCCT

CCAGGATACGGAGGCGGGTCGTTTTGCAACTTTTTTTTGGAGGCCGGATGAGACTAGTAAGCGCGGAAAGCG

GCCGACCGCGATGGCTCGCTGCCGTAGTCTGGAGAAGAATCGCCAGGGTTGCGTTGCGGTGTGCCCCGGTTC

GAGGCCGGCCGGATTCCGCGGCTAACGAGGGCGTGGCTGCCCCGTCGTTTCCAAGACCCCATAGCCAGCCGA

CTTCTCCAGTTACGGAGCGAGCCCCTCTTTTGTTTTGTTTGTTTTTGCCAGATGCATCCCGTACTGCGGCAGAT

GCGCCCCACCACCCTCCACCGCAACAACAGCCCCCTCCACAGCCGGCGCTTCTGCCCCCGCCCCAGCAGCAA

CTTCCAGCCACGACCGCCGCGGCCGCCGTGAGCGGGGCTGGACAGAGTTATGATCACCAGCTGGCCTTGGAA
```

-continued

```
GAGGGCGAGGGGCTGGCGCGCCTGGGGGCGTCGTCGCCGGAGCGGCACCCGCGCGTGCAGATGAAAAGGGA

CGCTCGCGAGGCCTACGTGCCCAAGCAGAACCTGTTCAGAGACAGGAGCGGCGAGGAGCCCGAGGAGATGC

GCGCGGCCCGGTTCCACGCGGGGCGGGAGCTGCGGCGCGGCCTGGACCGAAAGAGGGTGCTGAGGGACGAG

GATTTCGAGGCGGACGAGCTGACGGGGATCAGCCCCGCGCGCGCACGTGGCCGCGGCCAACCTGGTCACG

GCGTACGAGCAGACCGTGAAGGAGGAGAGCAACTTCCAAAAATCCTTCAACAACCACGTGCGCACCCTGATC

GCGCGCGAGGAGGTGACCCTGGGCCTGATGCACCTGTGGGACCTGCTGGAGGCCATCGTGCAGAACCCCACC

AGCAAGCCGCTGACGGCGCAGCTGTTCCTGGTGGTGCAGCATAGTCGGGACAACGAAGCGTTCAGGGAGGCG

CTGCTGAATATCACCGAGCCCGAGGGCCGCTGGCTCCTGGACCTGGTGAACATTCTGCAGAGCATCGTGGTGC

AGGAGCGCGGGCTGCCGCTGTCCGAGAAGCTGGCGGCCATCAACTTCTCGGTGCTGAGTTTGGGCAAGTACT

ACGCTAGGAAGATCTACAAGACCCCGTACGTGCCCATAGACAAGGAGGTGAAGATCGACGGGTTTTACATGC

GCATGACCCTGAAAGTGCTGACCCTGAGCGACGATCTGGGGGTGTACCGCAACGACAGGATGCACCGTGCGG

TGAGCGCCAGCAGGCGGCGCGAGCTGAGCGACCAGGAGCTGATGCATAGTCTGCAGCGGGCCCTGACCGGG

GCCGGGACCGAGGGGGAGAGCTACTTTGACATGGGCGCGGACCTGCACTGGCAGCCCAGCCGCCGGGCCTTG

GAGGCGGCGGCAGGACCCTACGTAGAAGAGGTGGACGATGAGGTGGACGAGGAGGGCGAGTACCTGGAAGA

CTGATGGCGCGACCGTATTTTTGCTAGATGCAACAACAACAGCCACCTCCTGATCCCGCGATGCGGGCGGCGC

TGCAGAGCCAGCCGTCCGGCATTAACTCCTCGGACGATTGGACCCAGGCCATGCAACGCATCATGGCGCTGA

CGACCCGCAACCCCGAAGCCTTTAGACAGCAGCCCCAGGCCAACCGGCTCTCGGCCATCCTGGAGGCCGTGG

TGCCCTCGCGCTCCAACCCCACGCACGAGAAGGTCCTGGCCATCGTGAACGCGCTGGTGGAGAACAAGGCCA

TCCGCGGCGACGAGGCCGGCCTGGTGTACAACGCGCTGCTGGAGCGCGTGGCCCGCTACAACAGCACCAACG

TGCAGACCAACCTGGACCGCATGGTGACCGACGTGCGCGAGGCCGTGGCCCAGCGCGAGCGGTTCCACCGCG

AGTCCAACCTGGGATCCATGGTGGCGCTGAACGCCTTCCTCAGCACCCAGCCCGCCAACGTGCCCCGGGCC

AGGAGGACTACACCAACTTCATCAGCGCCCTGCGCCTGATGGTGACCGAGGTGCCCCAGAGCGAGGTGTACC

AGTCCGGGCCGGACTACTTCTTCCAGACCAGTCGCCAGGGCTTGCAGACCGTGAACCTGAGCCAGGCTTTCAA

GAACTTGCAGGGCCTGTGGGGCGTGCAGGCCCCGGTCGGGGACCGCGCGACGGTGTCGAGCCTGCTGACGCC

GAACTCGCGCCTGCTGCTGCTGCTGGTGGCCCCCTTCACGGACAGCGGCAGCATCAACCGCAACTCGTACCTG

GGCTACCTGATTAACCTGTACCGCGAGGCCATCGGCCAGGCGCACGTGGACGAGCAGACCTACCAGGAGATC

ACCCACGTGAGCCGCGCCCTGGGCCAGGACGACCCGGGCAACCTGGAAGCCACCCTGAACTTTTTGCTGACC

AACCGGTCGCAGAAGATCCCGCCCCAGTACGCGCTCAGCACCGAGGAGGAGCGCATCCTGCGTTACGTGCAG

CAGAGCGTGGGCCTGTTCCTGATGCAGGAGGGGGCCACCCCCAGCGCCGCGCTCGACATGACCGCGCGCAAC

ATGGAGCCCAGCATGTACGCCAGCAACCGCCCGTTCATCAATAAACTGATGGACTACTTGCATCGGGCGGCC

GCCATGAACTCTGACTATTTCACCAACGCCATCCTGAATCCCCACTGGCTCCCGCCGCCGGGGTTCTACACGG

GCGAGTACGACATGCCCGACCCCAATGACGGGTTCCTGTGGGACGATGTGGACAGCAGCGTGTTCTCCCCCC

GACCGGGTGCTAACGAGCGCCCCTTGTGGAAGAAGGAAGGCAGCGACCGACGCCCGTCCTCGGCGCTGTCCG

GCCGCGAGGGTGCTGCCGCGGCGGTGCCCGAGGCCGCCAGTCCTTTCCCGAGCTTGCCCTTCTCGCTGAACAG

TATCCGCAGCAGCGAGCTGGGCAGGATCACGCGCCCGCGCTTGCTGGGCGAAGAGGAGTACTTGAATGACTC

GCTGTTGAGACCCGAGCGGGAGAAGAACTTCCCCAATAACGGGATAGAAAGCCTGGTGGACAAGATGAGCC

GCTGGAAGACGTATGCGCAGGAGCACAGGGACGATCCCCGGGCGTCGCAGGGGGCCACGAGCCGGGGCAGC

GCCGCCCGTAAACGCCGGTGGCACGACAGGCAGCGGGGACAGATGTGGGACGATGAGGACTCCGCCGACGA

CAGCAGCGTGTTGGACTTGGGTGGGAGTGGTAACCCGTTCGCTCACCTGCGCCCCCGTATCGGGCGCATGATG

TAAGAGAAACCGAAAATAAATGATACTCACCAAGGCCATGGCGACCAGCGTGCGTTCGTTTCTTCTCTGTTGT

TGTTGTATCTAGTATGATGAGGCGTGCGTACCCGGAGGGTCCTCCTCCCTCGTACGAGAGCGTGATGCAGCAG
```

```
GCGATGGCGGCGGCGGCGATGCAGCCCCCGCTGGAGGCTCCTTACGTGCCCCCGCGGTACCTGGCGCCTACG

GAGGGGCGGAACAGCATTCGTTACTCGGAGCTGGCACCCTTGTACGATACCACCCGGTTGTACCTGGTGGAC

AACAAGTCGGCGGACATCGCCTCGCTGAACTACCAGAACGACCACAGCAACTTCCTGACCACCGTGGTGCAG

AACAATGACTTCACCCCCACGGAGGCCAGCACCCAGACCATCAACTTTGACGAGCGCTCGCGGTGGGCGGC

CAGCTGAAAACCATCATGCACACCAACATGCCCAACGTGAACGAGTTCATGTACAGCAACAAGTTCAAGGCG

CGGGTGATGGTCTCCCGCAAGACCCCCAATGGGGTGACAGTGACAGAGGATTATGATGGTAGTCAGGATGAG

CTGAAGTATGAATGGGTGGAATTTGAGCTGCCCGAAGGCAACTTCTCGGTGACCATGACCATCGACCTGATG

AACAACGCCATCATCGACAATTACTTGGCGGTGGGGCGGCAGAACGGGGTGCTGGAGAGCGACATCGGCGTG

AAGTTCGACACTAGGAACTTCAGGCTGGGCTGGGACCCCGTGACCGAGCTGGTCATGCCCGGGGTGTACACC

AACGAGGCTTTCCATCCCGATATTGTCTTGCTGCCCGGCTGCGGGGTGGACTTCACCGAGAGCCGCCTCAGCA

ACCTGCTGGGCATTCGCAAGAGGCAGCCCTTCCAGGAAGGCTTCCAGATCATGTACGAGGATCTGGAGGGGG

GCAACATCCCCGCGCTCCTGGATGTCGACGCCTATGAGAAAAGCAAGGAGGATGCAGCAGCTGAAGCAACTG

CAGCCGTAGCTACCGCCTCTACCGAGGTCAGGGGCGATAATTTTGCAAGCGCCGCAGCAGTGGCAGCGGCCG

AGGCGGCTGAAACCGAAAGTAAGATAGTCATTCAGCCGGTGGAGAAGGATAGCAAGAACAGGAGCTACAAC

GTACTACCGGACAAGATAAACACCGCCTACCGCAGCTGGTACCTAGCCTACAACTATGGCGACCCCGAGAAG

GGCGTGCGCTCCTGGACGCTGCTCACCACCTCGGACGTCACCTGCGCGTGGAGCAAGTCTACTGGTCGCTGC

CCGACATGATGCAAGACCCGGTCACCTTCCGCTCCACGCGTCAAGTTAGCAACTACCCGGTGGTGGGCGCCG

AGCTCCTGCCCGTCTACTCCAAGAGCTTCTTCAACGAGCAGGCCGTCTACTCGCAGCAGCTGCGCGCCTTCAC

CTCGCTTACGCACGTCTTCAACCGCTTCCCCGAGAACCAGATCCTCGTCCGCCCGCCCGCGCCCACCATTACC

ACCGTCAGTGAAAACGTTCCTGCTCTCACAGATCACGGGACCCTGCCGCTGCGCAGCAGTATCCGGGGAGTC

CAGCGCGTGACCGTTACTGACGCCAGACGCCGCACCTGCCCCTACGTCTACAAGGCCCTGGGCATAGTCGCG

CCGCGCGTCCTCTCGAGCCGCACCTTCTAAATGTCCATTCTCATCTCGCCCAGTAATAACACCGGTTGGGGCC

TGCGCGCGCCCAGCAAGATGTACGGAGGCGCTCGCCAACGCTCCACGCAACACCCCGTGCGCGTGCGCGGGC

ACTTCCGCGCTCCCTGGGGCGCCCTCAAGGGCCGCGTGCGGTCGCGCACCACCGTCGACGACGTGATCGACC

AGGTGGTGGCCGACGCGCGCAACTACACCCCCGCCGCCGCGCCCGTCTCCACCGTGGACGCCGTCATCGACA

GCGTGGTGGCcGACGCGCGCCGGTACGCCCGCGCCAAGAGCCGGCGGCGGCGCATCGCCCGGCGGCACCGGA

GCACCCCCGCCATGCGCGCGGCGCGAGCCTTGCTGCGCAGGGCCAGGCGCACGGGACGCAGGGCCATGCTCA

GGGCGGCCAGACGCGCGGCTTCAGGCGCCAGCGCCGGCAGGACCCGGAGACGCGCGGCCACGGCGGCGGCA

GCGGCCATCGCCAGCATGTCCCGCCCGCGGCGAGGGAACGTGTACTGGGTGCGCGACGCCGCCACCGGTGTG

CGCGTGCCCGTGCGCACCCGCCCCCCTCGCACTTGAAGATGTTCACTTCGCGATGTTGATGTGTCCCAGCGGC

GAGGAGGATGTCCAAGCGCAAATTCAAGGAAGAGATGCTCCAGGTCATCGCGCCTGAGATCTACGGCCCTGC

GGTGGTGAAGGAGGAAAGAAAGCCCCGCAAAATCAAGCGGGTCAAAAAGGACAAAAAGGAAGAAGAAAGT

GATGTGGACGGATTGGTGGAGTTTGTGCGCGAGTTCGCCCCCCGGCGGCGCGTGCAGTGGCGCGGGCGGAAG

GTGCAACCGGTGCTGAGACCCGGCACCACCGTGGTCTTCACGCCCGGCGAGCGCTCCGGCACCGCTTCCAAG

CGCTCCTACGACGAGGTGTACGGGGATGATGATATTCTGGAGCAGGCGGCCGAGCGCCTGGGCGAGTTTGCT

TACGGCAAGCGCAGCCGTTCCGCACCGAAGGAAGAGGCGGTGTCCATCCCGCTGGACCACGGCAACCCCACG

CCCGAGCCTCAAGCCCGTGACCTTGCAGCAGGTGCTGCCGACCGCGGCGCCGCGCCGGGGGTTCAAGCGCGAG

GGCGAGGATCTGTACCCCACCATGCAGCTGATGGTGCCCAAGCGCCAGAAGCTGGAAGACGTGCTGGAGACC

ATGAAGGTGGACCCGGACGTGCAGCCCGAGGTCAAGGTGCGCCCATCAAGCAGGTGGCCCCGGGCCTGGG

CGTGCAGACCGTGGACATCAAGATTCCCACGGAGCCCATGGAAACGCAGACCGAGCCCATGATCAAGCCCAG
```

-continued

```
CACCAGCACCATGGAGGTGCAGACGGATCCCTGGATGCCATCGGCTCCTAGTCGAAGACCCCGGCGCAAGTA
CGGCGCGGCCAGCCTGCTGATGCCCAACTACGCGCTGCATCCTTCCATCATCCCCACGCCGGGCTACCGCGGC
ACGCGCTTCTACCGCGGTCATACCAGCAGCCGCCGCCGCAAGACCACCACTCGCCGCCGCCGTCGCCGCACC
GCCGCTGCAACCACCCCTGCCGCCCTGGTGCGGAGAGTGTACCGCCGCGGCCGCGCACCTCTGACCCTGCCGC
GCGCGCGCTACCACCCGAGCATCGCCATTTAAACTTTCGCCtGCTTTGCAGATCAATGGCCCTCACATGCCGCC
TTCGCGTTCCCATTACGGGCTACCGAGGAAGAAAACCGCGCCGTAGAAGGCTGGCGGGGAACGGGATGCGTC
GCCACCACCACCGGCGGCGGCGCGCCATCAGCAAGCGGTTGGGGGGAGGCTTCCTGCCCGCGCTGATCCCCA
TCATCGCCGCGGCGATCGGGGCGATCCCCGGCATTGCTTCCGTGGCGGTGCAGGCCTCTCAGCGCCACTGAGA
CACACTTGGAAACATCTTGTAATAAACCaATGGACTCTGACGCTCCTGGTCCTGTGATGTGTTTTCGTAGACAG
ATGGAAGACATCAATTTTTCGTCCCTGGCTCCGCGACACGGCACGCGGCCGTTCATGGGCACCTGGAGCGAC
ATCGGCACCAGCCAACTGAACGGGGGCGCCTTCAATTGGAGCAGTCTCTGGAGCGGGCTTAAGAATTTCGGG
TCCACGCTTAAAACCTATGGCAGCAAGGCGTGGAACAGCACCACAGGGCAGGCGCTGAGGGATAAGCTGAA
AGAGCAGAACTTCCAGCAGAAGGTGGTCGATGGGCTCGCCTCGGGCATCAACGGGGTGGTGGACCTGGCCAA
CCAGGCCGTGCAGCGGCAGATCAACAGCCGCCTGGACCCGGTGCCGCCCGCCGGCTCCGTGGAGATGCCGCA
GGTGGAGGAGGAGCTGCCTCCCCTGGACAAGCGGGGCGAGAAGCGACCCCGCCCCGATGCGGAGGAGACGC
TGCTGACGCACACGGACGAGCCGCCCCCGTACGAGGAGGCGGTGAAACTGGGTCTGCCCACCACGCGGCCCA
TCGCGCCCCTGGCCACCGGGGTGCTGAAACCCGAAAAGCCCGCGACCCTGGACTTGCCTCCTCCCCAGCCTTC
CCGCCCCTCTACAGTGGCTAAGCCCCTGCCGCCGGTGGCCGTGGCCCGCGCGCGACCCGGGGGCACCGCCCG
CCCTCATGCGAACTGGCAGAGCACTCTGAACAGCATCGTGGGTCTGGGAGTGCAGAGTGTGAAGCGCCGCCG
CTGCTATTAAACCTACCGTAGCGCTTAACTTGCTTGTCTGTGTGTATGTATTATGTCGCCGCCGCCGCTGTC
CACCAGAAGGAGGAGTGAAGAGGCGCGTCGCCGAGTTGCAAGATGGCCACCCCATCGATGCTGCCCCAGTGG
GCGTACATGCACATCGCCGGACAGGACGCTTCGGAGTACCTGAGTCCGGGTCTGGTGCAGTTTGCCCGCGCC
ACAGACACCTACTTCAGTCTGGGGAACAAGTTTAGGAACCCCACGGTGGCGCCCACGCACGATGTGACCACC
GACCGCAGCCAGCGGCTGACGCTGCGCTTCGTGCCCGTGGACCGCGAGGACAACACCTACTCGTACAAAGTG
CGCTACACGCTGGCCGTGGGCGACAACCGCGTGCTGGACATGGCCAGCACCTACTTTGACATCCGCGGCGTG
CTGGATCGGGGCCCTAGCTTCAAACCCTACTCCGGCACCGCCTACAACAGTCTGGCCCCCAAGGGAGCACCC
AACACTTGTCAGTGGACATATAAAGCCGATGGTGAAACTGCCACAGAAAAAACCTATACATATGGAAATGCA
CCCGTGCAGGGCATTAACATCACAAAAGATGGTATTCAACTTGGAACTGACACCGATGATCAGCCAATCTAC
GCAGATAAAACCTATCAGCCTGAACCTCAAGTGGGTGATGCTGAATGGCATGACATCACTGGTACTGATGAA
AAGTATGGAGGCAGAGCTCTTAAGCCTGATACCAAAATGAAGCCTTGTTATGGTTCTTTTGCCAAGCCTACTA
ATAAAGAAGGAGGTCAGGCAAATGTGAAAACAGGAACAGGCACTACTAAAGAATATGACATAGACATGGCT
TTCTTTGACAACAGAAGTGCGGCTGCTGCTGGCCTAGCTCCAGAAATTGTTTTGTATACTGAAAATGTGGATT
TGGAAACTCCAGATACCCATATTGTATACAAAGCAGGCACAGATGACAGCAGCTCTTCTATTAATTTGGGTCA
GCAAGCCATGCCCAACAGACCTAACTACATTGGTTTCAGAGACAACTTTATCGGGCTCATGTACTACAACAGC
ACTGGCAATATGGGGGTGCTGGCCGGTCAGGCTTCTCAGCTGAATGCTGTGGTTGACTTGCAAGACAGAAAC
ACCGAGCTGTCCTACCAGCTCTTGCTTGACTCTCTGGGTGACAGAACCCGGTATTTCAGTATGTGGAATCAGG
CGGTGGACAGCTATGATCCTGATGTGCGCATTATTGAAAATCATGGTGTGGAGGATGAACTTCCCAACTATTG
TTTCCCTCTGGATGCTGTTGGCAGAACAGATACTTATCAGGGAATTAAGGCTAATGGAACTGATCAAACCACA
TGGACCAAAGATGACAGTGTCAATGATGCTAATGAGATAGGCAAGGGTAATCCATTCGCCATGGAAATCAAC
ATCCAAGCCAACCTGTGGAGGAACTTCCTCTACGCCAACGTGGCCCTGTACCTGCCCGACTCTTACAAGTACA
CGCCGGCCAATGTTACCCTGCCCACCAACACCAACACCTACGATTACATGAACGGCCGGGTGGTGGCGCCCT
```

-continued

```
CGCTGGTGGACTCCTACATCAACATCGGGGCGCGCTGGTCGCTGGATCCCATGGACAACGTGAACCCCTTCAA

CCACCACCGCAATGCGGGGCTGCGCTACCGCTCCATGCTCCTGGGCAACGGGCGCTACGTGCCCTTCCACATC

CAGGTGCCCCAGAAATTTTTCGCCATCAAGAGCCTCCTGCTCCTGCCCGGGTCCTACACCTACGAGTGGAACT

TCCGCAAGGACGTCAACATGATCCTGCAGAGCTCCCTCGGCAACGACCTGCGCACGGACGGGGCCTCCATCT

CCTTCACCAGCATCAACCTCTACGCCACCTTCTTCCCCATGGCGCACAACACGGCCTCCACGCTCGAGGCCAT

GCTGCGCAACGACACCAACGACCAGTCCTTCAACGACTACCTCTCGGCGGCCAACATGCTCTACCCCATCCCG

GCCAACGCCACCAACGTGCCCATCTCCATCCCCTCGCGCAACTGGGCCGCCTTCCGCGGCTGGTCCTTCACGC

GTCTCAAGACCAAGGAGACGCCCTCGCTGGGCTCCGGGTTCGACCCCTACTTCGTCTACTCGGGCTCCATCCC

CTACCTCGACGGCACCTTCTACCTCAACCACACCTTCAAGAAGGTCTCCATCACCTTCGACTCCTCCGTCAGCT

GGCCCGGCAACGACCGGCTCCTGACGCCCAACGAGTTCGAAATCAAGCGCACCGTCGACGGCGAGGGCTACA

ACGTGGCCCAGTGCAACATGACCAAGGACTGGTTCCTGGTCCAGATGCTGGCCCACTACAACATCGGCTACC

AGGGCTTCTACGTGCCCGAGGGCTACAAGGACCGCATGTACTCCTTCTTCCGCAACTTCCAGCCCATGAGCCG

CCAGGTGGTGGACGAGGTCAACTACAAGGACTACCAGGCCGTCACCCTGGCCTACCAGCACAACAACTCGGG

CTTCGTCGGCTACCTCGCGCCCACCATGCGCCAGGGCCAGCCCTACCCCGCCAACTACCCCTACCCGCTCATC

GGCAAGAGCGCCGTCACCAGCGTCACCCAGAAAAAGTTCCTCTGCGACAGGGTCATGTGGCGCATCCCCTTC

TCCAGCAACTTCATGTCCATGGGCGCGCTCACCGACCTCGGCCAGAACATGCTCTATGCCAACTCCGCCCACG

CGCTAGACATGAATTTCGAAGTCGACCCCATGGATGAGTCCACCCTTCTCTATGTTGTCTTCGAAGTCTTCGAC

GTCGTCCGAGTGCACCAGCCCCACCGCGGCGTCATCGAGGCCGTCTACCTGCGCACCCCCTTCTCGGCCGGTA

ACGCCACCACCTAAGCTCTTGCTTCTTGCAAGCCATGGCCGCGGGCTCCGGCGAGCAGGAGCTCAGGGCCAT

CATCCGCGACCTGGGCTGCGGGCCCTACTTCCTGGGCACCTTCGATAAGCGCTTCCCGGGATTCATGGCCCCG

CACAAGCTGGCCTGCGCCATCGTCAACACGGCCGGCCGCGAGACCGGGGGCGAGCACTGGCTGGCCTTCGCC

TGGAACCCGCGCTCGAACACCTGCTACCTCTTCGACCCCTTCGGGTTCTCGGACGAGCGCCTCAAGCAGATCT

ACCAGTTCGAGTACGAGGGCCTGCTGCGCCGCAGCGCCCTGGCCACCGAGGACCGCTGCGTCACCCTGGAAA

AGTCCACCCAGACCGTGCAGGGTCCGCGCTCGGCCGCCTGCGGGCTCTTCTGCTGCATGTTCCTGCACGCCTT

CGTGCACTGGCCCGACCGCCCCATGGACAAGAACCCCACCATGAACTTGCTGACGGGGGTGCCCAACGGCAT

GCTCCAGTCGCCCCAGGTGGAACCCACCCTGCGCCGCAACCAGGAGGCGCTCTACCGCTTCCTCAACTCCCAC

TCCGCCTACTTTCGCTCCCACCGCGCGCGCATCGAGAAGGCCACCGCCTTCGACCGCATGAATCAAGACATGT

AAACCGTGTGTATGTTAAATGTCTTTAATAAACAGCACTTTCATGTTACACATGCATCTGAGATGATTTATT

TAGAAATCGAAAGGGTTCTGCCGGGTCTCGGCATGGCCCGCGGGCAGGGACACGTTGCGGAACTGGTACTTG

GCCAGCCACTTGAACTCGGGGATCAGCAGTTTGGGCAGCGGGGTGTCGGGGAAGGAGTCGGTCCACAGCTTC

CGCGTCAGTTGCAGGGCGCCCAGCAGGTCGGGCGCGGAGATCTTGAAATCGCAGTTGGGACCCGCGTTCTGC

GCGCGGGAGTTGCGGTACACGGGGTTGCAGCACTGGAACACCATCAGGGCCGGGTGCTTCACGCTCGCCAGC

ACCGTCGCGTCGGTGATGCTCTCCACGTCGAGGTCCTCGGCGTTGGCCATCCCGAAGGGGGTCATCTTGCAGG

TCTGCCTTCCCATGGTGGGCACGCACCCGGGCTTGTGGTTGCAATCGCAGTGCAGGGGATCAGCATCATCTG

GGCCTGGTCGGCGTTCATCCCCGGGTACATGGCCTTCATGAAAGCCTCCAATTGCCTGAACGCCTGCTGGGCC

TTGGCTCCCTCGGTGAAGAAGACCCCGCAGGACTTGCTAGAGAACTGGTTGGTGGCGCACCCGGCGTCGTGC

ACGCAGCAGCGCGCGTCGTTGTTGGCCAGCTGCACCACGCTGCGCCCCCAGCGGTTCTGGGTGATCTTGGCCC

GGTCGGGGTTCTCCTTCAGCGCGCGCTGCCCGTTCTCGCTCGCCACATCCATCTCGATCATGTGCTCCTTCTGG

ATCATGGTGGTCCCGTGCAGGCACCGCAGCTTGCCCTCGGCCTCGGTGCACCCGTGCAGCCACAGCGCGCACC

CGGTGCACTCCCAGTTCTTGTGGGCGATCTGGGAATGCGCGTGCACGAAGCCCTGCAGGAAGCGGCCCATCA
```

-continued
```
TGGTGGTCAGGGTCTTGTTGCTAGTGAAGGTCAGCGGAATGCCGCGGTGCTCCTCGTTGATGTACAGGTGGCA

GATGCGGCGGTACACCTCGCCCTGCTCGGGCATCAGCTGGAAGTTGGCTTTCAGGTCGGTCTCCACGCGGTAG

CGGTCCATCAGCATAGTCATGATTTCCATACCCTTCTCCCAGGCCGAGACGATGGGCAGGCTCATAGGGTTCT

TCACCATCATCTTAGCGCTAGCAGCCGCGGCCAGGGGGTCGCTCTCGTCCAGGGTCTCAAAGCTCCGCTTGCC

GTCCTTCTCGGTGATCCGCACCGGGGGGTAGCTGAAGCCCACGGCCGCCAGCTCCTCCTCGGCCTGTCTTTCG

TCCTCGCTGTCCTGGCTGACGTCCTGCAGGACCACATGCTTGGTCTTGCGGGGTTTCTTCTTGGGCGGCAGCG

GCGGCGGAGATGTTGGAGATGGCGAGGGGGAGCGCGAGTTCTCGCTCACCACTACTATCTCTTCCTCTTCTTG

GTCCGAGGCCACGCGGCGGTAGGTATGTCTCTTCGGGGGCAGAGGCGGAGGCGACGGGCTCTCGCCGCCGCG

ACTTGGCGGATGGCTGGCAGAGCCCCTTCCGCGTTCGGGGGTGCGCTCCCGGCGGCGCTCTGACTGACTTCCT

CCGCGGCCGGCCATTGTGTTCTCCTAGGGAGGAACAACAAGCATGGAGACTCAGCCATCGCCAACCTCGCCA

TCTGCCCCACCGCCGACGAGAAGCAGCAGCAGCAGAATGAAAGCTTAACCGCCCCGCCGCCCAGCCCCGCC

ACCTCCGACGCGGCCGTCCCAGACATGCAAGAGATGGAGGAATCCATCGAGATTGACCTGGGCTATGTGACG

CCCGCGGAGCACGAGGAGGAGCTGGCAGTGCGCTTTTCACAAGAAGAGATACACCAAGAACAGCCAGAGCA

GGAAGCAGAGAATGAGCAGAGTCAGGCTGGGCTCGAGCATGACGGCGACTACCTCCACCTGAGCGGGGGGG

AGGACGCGCTCATCAAGCATCTGGCCCGGCAGGCCACCATCGTCAAGGATGCGCTGCTCGACCGCACCGAGG

TGCCCCTCAGCGTGGAGGAGCTCAGCCGCGCCTACGAGTTGAACCTCTTCTCGCCGCGCGTGCCCCCCAAGCG

CCAGCCCAATGGCACCTGCGAGCCCAACCCGCGCCTCAACTTCTACCCGGTCTTCGCGGTGCCCGAGGCCCTG

GCCACCTACCACATCTTTTTCAAGAACCAAAAGATCCCCGTCTCCTGCCGCGCCAACCGCACCCGCGCCGACG

CCCTTTTCAACCTGGGTCCCGGCGCCCGCCTACCTGATATCGCCTCCTTGGAAGAGGTTCCCAAGATCTTCGA

GGGTCTGGGCAGCGACGAGACTCGGGCCGCGAACGCTCTGCAAGGAGAAGGAGGAGAGCATGAGCACCACA

GCGCCCTGGTCGAGTTGGAAGGCGACAACGCGCGGCTGGCGGTGCTCAAACGCACGGTCGAGCTGACCCATT

TCGCCTACCCGGCTCTGAACCTGCCCCCCAAAGTCATGAGCGCGGTCATGGACCAGGTGCTCATCAAGCGCGC

GTCGCCCATCTCCGAGGACGAGGGCATGCAAGACTCCGAGGAGGGCAAGCCCGTGGTCAGCGACGAGCAGC

TGGCCCGGTGGCTGGGTCCTAATGCTAGTCCCCAGAGTTTGGAAGAGCGGCGCAAACTCATGATGGCCGTGG

TCCTGGTGACCGTGGAGCTGGAGTGCCTGCGCCGCTTCTTCGCCGACGCGGAGACCCTGCGCAAGGTCGAGG

AGAACCTGCACTACCTCTTCAGGCACGGGTTCGTGCGCCAGGCCTGCAAGATCTCCAACGTGGAGCTGACCA

ACCTGGTCTCCTACATGGGCATCTTGCACGAGAACCGCCTGGGGCAGAACGTGCTGCACACCACCCTGCGCG

GGGAGGCCCGGCGCGACTACATCCGCGACTGCGTCTACCTCTACCTCTGCCACACCTGGCAGACGGGCATGG

GCGTGTGGCAGCAGTGTCTGGAGGAGCAGAACCTGAAAGAGCTCTGCAAGCTCCTGCAGAAGAACCTCAAGG

GTCTGTGGACCGGGTTCGACGAGCGCACCACCGCCTCGGACCTGGCCGACCTCATTTTCCCCGAGCGCCTCAG

GCTGACGCTGCGCAACGGCCTGCCCGACTTTATGAGCCAAAGCATGTTGCAAAACTTTCGCTCTTTCATCCTC

GAACGCTCCGGAATCCTGCCCGCCACCTGCTCCGCGCTGCCCTCGGACTTCGTGCCGCTGACCTTCCGCGAGT

GCCCCCCGCCGCTGTGGAGCCACTGCTACCTGCTGCGCCTGGCCAACTACCTGGCCTACCACTCGGACGTGAT

CGAGGACGTCAGCGGCGAGGGCCTGCTCGAGTGCCACTGCCGCTGCAACCTCTGCACGCCGCACCGCTCCCT

GGCCTGCAACCCCCAGCTGCTGAGCGAGACCCAGATCATCGGCACCTTCGAGTTGCAAGGGCCCAGCGAAGG

CGAGGGTTCAGCCGCCAAGGGGGGTCTGAAACTCACCCCGGGGCTGTGGACCTCGGCCTACTTGCGCAAGTT

CGTGCCCGAGGACTACCATCCCTTCGAGATCAGGTTCTACGAGGACCAATCCCATCCGCCCAAGGCCGAGCT

GTCGGCCTGCGTCATCACCCAGGGGGCGATCCTGGCCCAATTGCAAGCCATCCAGAAATCCCGCCAAGAATT

CTTGCTGAAAAAGGGCCGCGGGGTCTACCTCGACCCCCAGACCGGTGAGGAGCTCAACCCCGGCTTCCCCCA

GGATGCCCCGAGGAAACAAGAAGCTGAAAGTGGAGCTGCCGCCCGTGGAGGATTTGGAGGAAGACTGGGAG

AACAGCAGTCAGGCAGAGGAGGAGGAGATGGAGGAAGACTGGGACAGCACTCAGGCAGAGGAGGACAGCC
```

-continued

```
TGCAAGACAGTCTGGAGGAAGACGAGGAGGAGGCAGAGGAGGAGGTGGAAGAAGCAGCCGCCGCCAGACC

GTCGTCCTCGGCGGGGGAGAAAGCAAGCAGCACGGATACCATCTCCGCTCCGGGTCGGGGTCCCGCTCGACC

ACACAGTAGATGGGACGAGACCGGACGATTCCCGAACCCCACCACCCAGACCGGTAAGAAGGAGCGGCAGG

GATACAAGTCCTGGCGGGGGCACAAAAACGCCATCGTCTCCTGCTTGCAGGCCTGCGGGGGCAACATCTCCT

TCACCCGGCGCTACCTGCTCTTCCACCGCGGGGTGAACTTTCCCCGCAACATCTTGCATTACTACCGTCACCTC

CACAGCCCCTACTACTTCCAAGAAGAGGCAGCAGCAGCAGAAAAAGACCAGCAGAAAACCAGCAGCTAGAA

AATCCACAGCGGCGGCAGCAGGTGGACTGAGGATCGCGGCGAACGAGCCGGCGCAAACCCGGGAGCTGAGG

AACCGGATCTTTCCCACCCTCTATGCCATCTTCCAGCAGAGTCGGGGGCAGGAGCAGGAACTGAAAGTCAAG

AACCGTTCTCTGCGCTCGCTCACCCGCAGTTGTCTGTATCACAAGAGCGAAGACCAACTTCAGCGCACTCTCG

AGGACGCCGAGGCTCTCTTCAACAAGTACTGCGCGCTCACTCTTAAAGAGTAGCCCGCGCCCGCCCAGTCGC

AGAAAAAGGCGGGAATTACGTCACCTGTGCCCTTCGCCCTAGCCGCCTCCACCCATCATCATGAGCAAAGAG

ATTCCCACGCCTTACATGTGGAGCTACCAGCCCCAGATGGGCCTGGCCGCCGGTGCCGCCCAGGACTACTCCA

CCCGCATGAATTGGCTCAGCGCCGGGCCCGCGATGATCTCACGGGTGAATGACATCCGCGCCCACCGAAACC

AGATACTCCTAGAACAGTCAGCGCTCACCGCCACGCCCCGCAATCACCTCAATCCGCGTAATTGGCCCGCCGC

CCTGGTGTACCAGGAAATTCCCCAGCCCACGACCGTACTACTTCCGCGAGACGCCCAGGCCGAAGTCCAGCT

GACTAACTCAGGTGTCCAGCTGGCGGGCGGCGCCACCCTGTGTCGTCACCGCCCCGCTCAGGGTATAAAGCG

GCTGGTGATCCGGGGCAGAGGCACACAGCTCAACGACGAGGTGGTGAGCTCTTCGCTGGGTCTGCGACCTGA

CGGAGTCTTCCAACTCGCCGGATCGGGGAGATCTTCCTTCACGCCTCGTCAGGCCGTCCTGACTTTGGAGAGT

TCGTCCTCGCAGCCCCGCTCGGGTGGCATCGGCACTCTCCAGTTCGTGGAGGAGTTCACTCCCTCGGTCTACTT

CAACCCCTTCTCCGGCTCCCCCGGCCACTACCCGGACGAGTTCATCCCGAACTTCGACGCCATCAGCGAGTCG

GTGGACGGCTACGATTGAAACTAATCACCCCCTTATCCAGTGAAATAAAGATCATATTGATGATGATTTTACA

GAAATAAAAAATAATCATTTGATTTGAAATAAAGATACAATCATATTGATGATTTGAGTTTAACAAAAAAAT

AAAGAATCACTTACTTGAAATCTGATACCAGGTCTCTGTCCATGTTTTCTGCCAACACCACTTCACTCCCCTCT

TCCCAGCTCTGGTACTGCAGGCCCCGGCGGGCTGCAAACTTCCTCCACACGCTGAAGGGGATGTCAAATTCCT

CCTGTCCCTCAATCTTCATTTTATCTTCTATCAGATGTCCAAAAAGCGCGTCCGGGTGGATGATGACTTCGACC

CCGTCTACCCCTACGATGCAGACAACGCACCGACCGTGCCCTTCATCAACCCCCCCTTCGTCTCTTCAGATGG

ATTCCAAGAGAAGCCCCTGGGGGTGTTGTCCCTGCGACTGGCCGACCCCGTCACCACCAAGAACGGGGAAAT

CACCCTCAAGCTGGGAGAGGGGTGGACCTCGATTCCTCGGGAAAACTCATCTCCAACACGGCCACCAAGGC

CGCCGCCCCTCTCAGTTTTTCCAACAACACCATTTCCCTTAACATGGATCACCCCTTTTACACTAAAGATGGAA

AATTATCCTTACAAGTTTCTCCACCATTAAATATACTGAGAACAAGCATTCTAAACACACTAGCTTTAGGTTTT

GGATCAGGTTTAGGACTCCGTGGCTCTGCCTTGGCAGTACAGTTAGTCTCTCCACTTACATTTGATACTGATGG

AAACATAAAGCTTACCTTAGACAGAGGTTTGCATGTTACAACAGGAGATGCAATTGAAAGCAACATAAGCTG

GGCTAAAGGTTTAAAATTTGAAGATGGAGCCATAGCAACCAACATTGGAAATGGGTTAGAGTTTGGAAGCAG

TAGTACAGAAACAGGTGTTGATGATGCTTACCCAATCCAAGTTAAACTTGGATCTGGCCTTAGCTTTGACAGT

ACAGGAGCCATAATGGCTGGTAACAAAGAAGACGATAAACTCACTTTGTGGACAACACCTGATCCATCACCA

AACTGTCAAATACTCGCAGAAAATGATGCAAAACTAACACTTTGCTTGACTAAATGTGGTAGTCAAATACTG

GCCACTGTGTCAGTCTTAGTTGTAGGAAGTGGAAACCTAAACCCCATTACTGGCACCGTAAGCAGTGCTCAGG

TGTTTCTACGTTTTGATGCAAACGGTGTTCTTTTAACAGAACATTCTACACTAAAAAATACTGGGGGTATAG

GCAGGGAGATAGCATAGATGGCACTCCATATACCAATGCTGTAGGATTCATGCCCAATTTAAAAGCTTATCCA

AAGTCACAAAGTTCTACTACTAAAAATAATATAGTAGGGCAAGTATACATGAATGGAGATGTTTCAAACCCT
```

-continued

ATGCTTCTCACTATAACCCTCAATGGTACTGATGACAGCAACAGTACATATTCAATGTCATTTTCATACACCTG

GACTAATGGAAGCTATGTTGGAGCAACATTTGGGGCTAACTCTTATACCTTCTCATACATCGCCCAAGAATGA

ACACTGTATCCCACCCTGCATGCCAACCCTTCCCACCCCACTCTGTGGAACAAACTCTGAAACACAAATAAA

ATAAAGTTCAAGTGTTTTATTGATTCAACAGTTTTACAGGATTCGAGCAGTTATTTTTCCTCCACCCTCCCAGG

ACATGGAATACACCACCCTCTCCCCCCGCACAGCCTTGAACATCTGAATGCCATTGGTGATGGACATGCTTTT

GGTCTCCACGTTCCACACAGTTTCAGAGCGAGCCAGTCTCGGGTCGGTCAGGGAGATGAAACCCTCCGGGCA

CTCCCGCATCTGCACCTCACAGCTCAACAGCTGAGGATTGTCCTCGGTGGTCGGGATCACGGTTATCTGGAAG

AAGCAGAAGAGCGGCGGTGGGAATCATAGTCCGCGAACGGGATCGGCCGGTGGTGTCGCATCAGGCCCCGC

AGCAGTCGCTGCCGCCGCCGCTCCGTCAAGCTGCTGCTCAGGGGGTCCGGGTCCAGGGACTCCCTCAGCATG

ATGCCCACGGCCCTCAGCATCAGTCGTCTGGTGCGGCGGGCGCAGCAGCGCATGCGGATCTCGCTCAGGTCG

CTGCAGTACGTGCAACACAGAACCACCAGGTTGTTCAACAGTCCATAGTTCAACACGCTCCAGCCGAAACTC

ATCGCGGGAAGGATGCTACCCACGTGGCCGTCGTACCAGATCCTCAGGTAAATCAAGTGGTGCCCCCTCCAG

AACACGCTGCCCACGTACATGATCTCCTTGGGCATGTGGCGGTTCACCACCTCCCGGTACCACATCACCCTCT

GGTTGAACATGCAGCCCCGGATGATCCTGCGGAACCACAGGGCCAGCACCGCCCCGCCCGCCATGCAGCGAA

GAGACCCCGGGTCCCGGCAATGGCAATGGAGGACCCACCGCTCGTACCCGTGGATCATCTGGGAGCTGAACA

AGTCTATGTTGGCACAGCACAGGCATATGCTCATGCATCTCTTCAGCACTCTCAACTCCTCGGGGGTCAAAAC

CATATCCCAGGGCACGGGGAACTCTTGCAGGACAGCGAACCCCGCAGAACAGGGCAATCCTCGCACAGAACT

TACATTGTGCATGGACAGGGTATCGCAATCAGGCAGCACCGGGTGATCCTCCACCAGAGAAGCGCGGGTCTC

GGTCTCCTCACAGCGTGGTAAGGGGGCCGGCCGATACGGGTGATGGCGGGACGCGGCTGATCGTGTTCGCGA

CCGTGTCATGATGCAGTTGCTTTCGGACATTTTCGTACTTGCTGTAGCAGAACCTGGTCCGGGCGCTGCACAC

CGATCGCCGGCGGCGGTCTCGGCGCTTGGAACGCTCGGTGTTGAAATTGTAAAACAGCCACTCTCTCAGACCG

TGCAGCAGATCTAGGGCCTCAGGAGTGATGAAGATCCCATCATGCCTGATGGCTCTGATCACATCGACCACC

GTGGAATGGGCCAGACCCAGCCAGATGATGCAATTTTGTTGGGTTTCGGTGACGGCGAGCCTCGGGAACAAC

GATGAAGTAAATGCAAGCGGTGCGTTCCAGCATGGTTAGTTAGCTGATCTGTAGAAAAAACAAAAATGAACA

TTAAACCATGCTAGCCTGGCGAACAGGTGGGTAAATCGTTCTCTCCAGCACCAGGCAGGCCACGGGGTCTCC

GGCGCGACCCTCGTAAAAATTGTCGCTATGATTGAAAACCATCACAGAGAGACGTTCCCGGTGGCCGGCGTG

AATGATTCGACAAGATGAATACACCCCCGGAACATTGGCGTCCGCGAGTGAAAAAAAGCGCCCGAGGAAGC

AATAAGGCACTACAATGCTCAGTCTCAAGTCCAGCAAAGCGATGCCATGCGGATGAAGCACAAAATTCTCAG

GTGCGTACAAAATGTAATTACTCCCCTCCTGCACAGGCAGCAAAGCCCCGATCCCTCCAGGTACACATACAA

AGCCTCAGCGTCCATAGCTTACCGAGCAGCAGCACACAACAGGCGCAAGAGTCAGAGAAAGGCTGAGCTCTA

ACCTGTCCACCCGCTCTCTGCTCAATATATAGCCCAGATCTACACTGACGTAAAGGCCAAAGTCTAAAAATAC

CCGCCAAATAATCACACACGCCCAGCACACGCCCAGAAACCGGTGACACACTCAAAAAAAATACGCGCACTTC

CTCAAACGCCCAAAACTGCCGTCATTTCCGGGTTCCCACGCTACGTCATCAAAACACGACTTTCAAATTCCGT

CGACCGTTAAAAACGTCACCCGCCCCGCCCCTAACGGTCGCCCGTCTCTCAGCCAATCAGCGCCCCGCATCCC

CAAATTCAAACACCTCATTTGCATATTAACGCGCACAAAAAGTTTGAGGTATATTATTGATGATG

ChAdV68-Empty-E4deleted (SEQ ID NO: 59)
CATCTTCAATAATATACCTCAAACTTTTTGTGCGCGTTAATATGCAAATGAGGCGTTTGAATTTGGGGAGGAA

GGGCGGTGATTGGTCGAGGGATGAGCGACCGTTAGGGGCGGGGCGAGTGACGTTTTGATGACGTGGTTGCGA

GGAGGAGCCAGTTTGCAAGTTCTCGTGGGAAAAGTGACGTCAAACGAGGTGTGGTTTGAACACGGAAATACT

CAATTTTCCCGCGCTCTCTGACAGGAAATGAGGTGTTTCTGGGCGGATGCAAGTGAAAACGGGCCATTTTCGC

GCGAAAACTGAATGAGGAAGTGAAAATCTGAGTAATTTCGCGTTTATGGCAGGGAGGAGTATTTGCCGAGGG

-continued

CCGAGTAGACTTTGACCGATTACGTGGGGGTTTCGATTACCGTGTTTTTCACCTAAATTTCCGCGTACGGTGTC

AAAGTCCGGTGTTTTTACGTAGGTGTCAGCTGATCGCCAGGGTATTTAAACCTGCGCTCTCCAGTCAAGAGGC

CACTCTTGAGTGCCAGCGAGAAGAGTTTTCTCCTCCGCGCCGCGAGTCAGATCTACACTTTGAAAGTAGGGata aGGTAGCGAGTGAGTAGTGTTCTGGGGCGGGGAGGACCTGCATGAGGGCCAGAATAACTGAAATCTGTGCT

TTTCTGTGTGTTGCAGCAGCATGAGCGGAAGCGGCTCCTTTGAGGGAGGGGTATTCAGCCCTTATCTGACGGG

GCGTCTCCCCTCCTGGGCGGGAGTGCGTCAGAATGTGATGGGATCCACGGTGGACGGCCGGCCCGTGCAGCC

CGCGAACTCTTCAACCCTGACCTATGCAACCCTGAGCTCTTCGTCGTTGGACGCAGCTGCCGCCGCAGCTGCT

GCATCTGCCGCCAGCGCCGTGCGCGGAATGGCCATGGGCGCCGGCTACTACGGCACTCTGGTGGCCAACTCG

AGTTCCACCAATAATCCCGCCAGCCTGAACGAGGAGAAGCTGTTGCTGCTGATGGCCCAGCTCGAGGCCTTG

ACCCAGCGCCTGGGCGAGCTGACCCAGCAGGTGGCTCAGCTGCAGGAGCAGACGCGGGCCGGTTGCCACG

GTGAAATCCAAATAAAAATGAATCAATAAATAAACGGAGACGGTTGTTGATTTTAACACAGAGTCTGAATC

TTTATTTGATTTTTCGCGCGCGGTAGGCCCTGGACCACCGGTCTCGATCATTGAGCACCCGGTGGATCTTTTCC

AGGACCCGGTAGAGGTGGGCTTGGATGTTGAGGTACATGGGCATGAGCCCGTCCCGGGGTGGAGGTAGCTC

CATTGCAGGGCCTCGTGCTCGGGGTGGTGTTGTAAATCACCCAGTCATAGCAGGGGCGCAGGGCATGGTGT

TGCACAATATCTTTGAGGAGGAGACTGATGGCCACGGGCAGCCCTTTGGTGTAGGTGTTTACAAATCTGTTGA

GCTGGGAGGGATGCATGCGGGGGGAGATGAGGTGCATCTTGGCCTGGATCTTGAGATTGGCGATGTTACCGC

CCAGATCCCGCCTGGGGTTCATGTTGTGCAGGACCACCAGCACGGTGTATCCGGTGCACTTGGGGAATTTATC

ATGCAACTTGGAAGGGAAGGCGTGAAAGAATTTGGCGACGCCTTTGTGCCCGCCCAGGTTTTCCATGCACTCA

TCCATGATGATGGCGATGGCCCGTGGGCGGCGGCCTGGGCAAAGACGTTTCGGGGGTCGGACACATCATAG

TTGTGGTCCTGGGTGAGGTCATCATAGGCCATTTTAATGAATTTGGGGCGGAGGGTGCCGGACTGGGGGACA

AAGGTACCCTCGATCCCGGGGCGTAGTTCCCCTCACAGATCTGCATCTCCCAGGCTTTGAGCTCGGAGGGGG

GGATCATGTCCACCTGCGGGGCGATAAAGAACACGGTTTCCGGGGCGGGGGAGATGAGCTGGGCCGAAAGC

AAGTTCCGGAGCAGCTGGGACTTGCCGCAGCCGGTGGGGCCGTAGATGACCCCGATGACCGGCTGCAGGTGG

TAGTTGAGGGAGAGACAGCTGCCGTCCTCCCGGAGGAGGGGGCCACCTCGTTCATCATCTCGCGCACGTGC

ATGTTCTCGCGCACCAGTTCCGCCAGGAGGCGCTCTCCCCCCAGGGATAGGAGCTCCTGGAGCGAGGCGAAG

TTTTTCAGCGGCTTGAGTCCGTCGGCCATGGGCATTTTGGAGAGGGTTTGTTGCAAGAGTTCCAGGCGGTCCC

AGAGCTCGGTGATGTGCTCTACGGCATCTCGATCCAGCAGACCTCCTCGTTTCGCGGGTTGGGACGGCTGCGG

GAGTAGGGCACCAGACGATGGGCGTCCAGCGCAGCCAGGGTCCGGTCCTTCCAGGGTCGCAGCGTCCGCGTC

AGGGTGGTCTCCGTCACGGTGAAGGGGTGCGCGCCGGGCTGGGCGCTTGCGAGGGTGCGCTTCAGGCTCATC

CGGCTGGTCGAAAACCGCTCCCGATCGGCGCCCTGCGCGTCGGCCAGGTAGCAATTGACCATGAGTTCGTAG

TTGAGCGCCTCGGCCGCGTGGCCTTTGGCGCGGAGCTTACCTTTGGAAGTCTGCCCGCAGGCGGGACAGAGG

AGGGACTTGAGGGCGTAGAGCTTGGGGGCGAGGAAGACGGACTCGGGGGCGTAGGCGTCCGCGCCGCAGTG

GGCGCAGACGGTCTCGCACTCCACGAGCCAGGTGAGGTCGGGCTGGTCGGGGTCAAAAACCAGTTTCCCGCC

GTTCTTTTTGATGCGTTTCTTACCTTTGGTCTCCATGAGCTCGTGTCCCCGCTGGGTGACAAAGAGGCTGTCCG

TGTCCCCGTAGACCGACTTTATGGGCCGGTCCTCGAGCGGTGTGCCGCGGTCCTCCTCGTAGAGGAACCCCGC

CCACTCCGAGACGAAAGCCCGGGTCCAGGCCAGCACGAAGGAGGCCACGTGGGACGGGTAGCGGTCGTTGT

CCACCAGCGGGTCCACCTTTTCCAGGGTATGCAAACACATGTCCCCCTCGTCCACATCCAGGAAGGTGATTGG

CTTGTAAGTGTAGGCCACGTGACCGGGGGTCCCGGCCGGGGGGTATAAAAGGGTGCGGGTCCCTGCTCGTC

CTCACTGTCTTCCGGATCGCTGTCCAGGAGCGCCAGCTGTTGGGGTAGGTATTCCCTCTCGAAGGCGGGCATG

ACCTCGGCACTCAGGTTGTCAGTTTCTAGAAACGAGGAGGATTTGATATTGACGGTGCCGGCGGAGATGCCTT

TCAAGAGCCCCTCGTCCATCTGGTCAGAAAAGACGATCTTTTTGTTGTCGAGCTTGGTGGCGAAGGAGCCGTA

-continued

```
GAGGGCGTTGGAGAGGAGCTTGGCGATGGAGCGCATGGTCTGGTTTTTTCCTTGTCGGCGCGCTCCTTGGCG
GCGATGTTGAGCTGCACGTACTCGCGCGCCACGCACTTCCATTCGGGGAAGACGGTGGTCAGCTCGTCGGGC
ACGATTCTGACCTGCCAGCCCCGATTATGCAGGGTGATGAGGTCCACACTGGTGGCCACCTCGCCGCGCAGG
GGCTCATTAGTCCAGCAGAGGCGTCCGCCCTTGCGCGAGCAGAAGGGGGCAGGGGGTCCAGCATGACCTCG
TCGGGGGGTCGGCATCGATGGTGAAGATGCCGGGCAGGAGGTCGGGGTCAAAGTAGCTGATGGAAGTGGC
CAGATCGTCCAGGGCAGCTTGCCATTCGCGCACGGCCAGCGCGCGCTCGTAGGGACTGAGGGGCGTGCCCCA
GGGCATGGGATGGGTAAGCGCGGAGGCGTACATGCCGCAGATGTCGTAGACGTAGAGGGGCTCCTCGAGGA
TGCCGATGTAGGTGGGGTAGCAGCGCCCCCCGCGGATGCTGGCGCGCACGTAGTCATACAGCTCGTGCGAGG
GGGCGAGGAGCCCCGGGCCCAGGTTGGTGCGACTGGGCTTTTCGGCGCGGTAGACGATCTGGCGGAAAATGG
CATGCGAGTTGGAGGAGATGGTGGGCCTTTGGAAGATGTTGAAGTGGGCGTGGGGCAGTCCGACCGAGTCGC
GGATGAAGTGGGCGTAGGAGTCTTGCAGCTTGGCGACGAGCTCGGCGGTGACTAGGACGTCCAGAGCGCAGT
AGTCGAGGGTCTCCTGGATGATGTCATACTTGAGCTGTCCCTTTTGTTTCCACAGCTCGCGGTTGAGAAGGAA
CTCTTCGCGGTCCTTCCAGTACTCTTCGAGGGGGAACCCGTCCTGATCTGCACGGTAAGAGCCTAGCATGTAG
AACTGGTTGACGGCCTTGTAGGCGCAGCAGCCCTTCTCCACGGGGAGGGCGTAGGCCTGGGCGGCCTTGCGC
AGGGAGGTGTGCGTGAGGGCGAAAGTGTCCCTGACCATGACCTTGAGGAACTGGTGCTTGAAGTCGATATCG
TCGCAGCCCCCCTGCTCCCAGAGCTGGAAGTCCGTGCGCTTCTTGTAGGCGGGGTTGGGCAAAGCGAAAGTA
ACATCGTTGAAGAGGATCTTGCCCGCGCGGGGCATAAAGTTGCGAGTGATGCGGAAAGGTTGGGGCACCTCG
GCCCGGTTGTTGATGACCTGGGCGGCGAGCACGATCTCGTCGAAGCCGTTGATGTTGTGGCCCACGATGTAGA
GTTCCACGAATCGCGGACGGCCCTTGACGTGGGGCAGTTTCTTGAGCTCCTCGTAGGTGAGCTCGTCGGGGTC
GCTGAGCCCGTGCTGCTCGAGCGCCCAGTCGGCGAGATGGGGGTTGGCGCGGAGGAAGGAAGTCCAGAGAT
CCACGGCCAGGGCGGTTTGCAGACGGTCCCGGTACTGACGGAACTGCTGCCCGACGGCCATTTTTTCGGGGGT
GACGCAGTAGAAGGTGCGGGGGTCCCCGTGCCAGCGATCCCATTTGAGCTGGAGGGCGAGATCGAGGGCGA
GCTCGACGAGCCGGTCGTCCCCGGAGAGTTTCATGACCAGCATGAAGGGGACGAGCTGCTTGCCGAAGGACC
CCATCCAGGTGTAGGTTTCCACATCGTAGGTGAGGAAGAGCCTTTCGGTGCGAGGATGCGAGCCGATGGGGA
AGAACTGGATCTCCTGCCACCAATTGGAGGAATGGCTGTTGATGTGATGGAAGTAGAAATGCCGACGGCGCG
CCGAACACTCGTGCTTGTGTTTATACAAGCGGCCACAGTGCTCGCAACGCTGCACGGGATGCACGTGCTGCAC
GAGCTGTACCTGAGTTCCTTTGACGAGGAATTTCAGTGGGAAGTGGAGTCGTGGCGCCTGCATCTCGTGCTGT
ACTACGTCGTGGTGGTCGGCCTGGCCCTCTTCTGCCTCGATGGTGGTCATGCTGACGAGCCCGCGCGGGAGGC
AGGTCCAGACCTCGGCGCGAGCGGGTCGGAGAGCGAGGACGAGGGCGCGCAGGCCGGAGCTGTCCAGGGTC
CTGAGACGCTGCGGAGTCAGGTCAGTGGGCAGCGGCGGCGCGCGGTTGACTTGCAGGAGTTTTTCCAGGGCG
CGCGGGAGGTCCAGATGGTACTTGATCTCCACCGCGCCATTGGTGGCGACGTCGATGGCTTGCAGGGTCCCGT
GCCCCTGGGGTGTGACCACCGTCCCCCGTTTCTTCTTGGGCGGCTGGGGCGACGGGGCGGTGCCTCTTCCAT
GGTTAGAAGCGGCGGCGAGGACGCGCGCCGGGCGGCAGGGGCGGCTCGGGGCCCGGAGGCAGGGGCGGCA
GGGGCACGTCGGCGCCGCGCGCGGGTAGGTTCTGGTACTGCGCCCGGAGAAGACTGGCGTGAGCGACGACGC
GACGGTTGACGTCCTGGATCTGACGCCTCTGGGTGAAGGCCACGGGACCCGTGAGTTTGAACCTGAAAGAGA
GTTCGACAGAATCAATCTCGGTATCGTTGACGGCGGCCTGCCGCAGGATCTCTTGCACGTCGCCCGAGTTGTC
CTGGTAGGCGATCTCGGTCATGAACTGCTCGATCTCCTCCTCTTGAAGGTCTCCGCGGCCGGCGCGCTCCACG
GTGGCCGCGAGGTCGTTGGAGATGCGGCCCATGAGCTGCGAGAAGGCGTTCATGCCCGCCTCGTTCCAGACG
CGGCTGTAGACCACGACGCCCTCGGGATCGCgGGCGCGCATGACCACCTGGGCGAGGTTGAGCTCCACGTGG
CGCGTGAAGACCGCGTAGTTGCAGAGGCGCTGGTAGAGGTAGTTGAGCGTGGTGGCGATGTGCTCGGTGACG
```

-continued

```
AAGAAATACATGATCCAGCGGCGGAGCGGCATCTCGCTGACGTCGCCCAGCGCCTCCAAACGTTCCATGGCC
TCGTAAAAGTCCACGGCGAAGTTGAAAAACTGGGAGTTGCGCGCCGAGACGGTCAACTCCTCCTCCAGAAGA
CGGATGAGCTCGGCGATGGTGGCGCGCACCTCGCGCTCGAAGGCCCCCGGGAGTTCCTCCACTTCCTCTTCTT
CCTCCTCCACTAACATCTCTTCTACTTCCTCCTCAGGCGGCAGTGGTGGCGGGGAGGGGCCTGCGTCGCCG
GCGGCGCACGGGCAGACGGTCGATGAAGCGCTCGATGGTCTCGCCGCGCCGGCGTCGCATGGTCTCGGTGAC
GGCGCGCCCGTCCTCGCGGGGCCGCAGCGTGAAGACGCCGCCGCGCATCTCCAGGTGGCCGGGGGGGTCCCC
GTTGGGCAGGGAGAGGGCGCTGACGATGCATCTTATCAATTGCCCCGTAGGGACTCCGCGCAAGGACCTGAG
CGTCTCGAGATCCACGGGATCTGAAAACCGCTGAACGAAGGCTTCGAGCCAGTCGCAGTCGCAAGGTAGGCT
GAGCACGGTTTCTTCTGGCGGGTCATGTTGGTTGGGAGCGGGGCGGGCGATGCTGCTGGTGATGAAGTTGAA
ATAGGCGGTTCTGAGACGGCGGATGGTGGCGAGGAGCACCAGGTCTTTGGGCCCGGCTTGCTGGATGCGCAG
ACGGTCGGCCATGCCCCAGGCGTGGTCCTGACACCTGGCCAGGTCCTTGTAGTAGTCCTGCATGAGCCGCTCC
ACGGGCACCTCCTCCTCGCCCGCGCGGCCGTGCATGCGCGTGAGCCCGAAGCCGCGCTGGGGCTGGACGAGC
GCCAGGTCGGCGACGACGCGCTCGGCGAGGATGGCTTGCTGGATCTGGGTGAGGGTGGTCTGGAAGTCATCA
AAGTCGACGAAGCGGTGGTAGGCTCCGGTGTTGATGGTGTAGGAGCAGTTGGCCATGACGGACCAGTTGACG
GTCTGGTGGCCCGGACGCACGAGCTCGTGGTACTTGAGGCGCGAGTAGGCGCGCGTGTCGAAGATGTAGTCG
TTGCAGGTGCGCACCAGGTACTGGTAGCCGATGAGGAAGTGCGGCGGCGGCTGGCGGTAGAGCGGCCATCGC
TCGGTGGCGGGGGCGCCGGGCGCGAGGTCCTCGAGCATGGTGCGGTGGTAGCCGTAGATGTACCTGGACATC
CAGGTGATGCCGGCGGCGGTGGTGGAGGCGCGCGGGAACTCGCGGACGCGGTTCCAGATGTTGCGCAGCGGC
AGGAAGTAGTTCATGGTGGGCACGGTCTGGCCCGTGAGGCGCGCAGTCGTGGATGCTCTATACGGGCAAA
AACGAAAGCGGTCAGCGGCTCGACTCCGTGGCCTGGAGGCTAAGCGAACGGGTTGGGCTGCGCGTGTACCCC
GGTTCGAATCTCGAATCAGGCTGGAGCCGCAGCTAACGTGGTATTGGCACTCCCGTCTCGACCCAAGCCTGCA
CCAACCCTCCAGGATACGGAGGCGGGTCGTTTTGCAACTTTTTTTTGGAGGCCGGATGAGACTAGTAAGCGCG
GAAAGCGGCCGACCGCGATGGCTCGCTGCCGTAGTCTGGAGAAGAATCGCCAGGGTTGCGTTGCGGTGTGCC
CCGGTTCGAGGCCGGCCGGATTCCGCGGCTAACGAGGGCGTGGCTGCCCCGTCGTTTCCAAGACCCCATAGC
CAGCCGACTTCTCCAGTTACGGAGCGAGCCCCTCTTTTGTTTTGTTTGTTTTGCCAGATGCATCCCGTACTGC
GGCAGATGCGCCCCCACCACCCTCCACCGCAACAACAGCCCCCTCCACAGCCGGCGCTTCTGCCCCCGCCCCA
GCAGCAACTTCCAGCCACGACCGCCGCGGCCGCCGTGAGCGGGGCTGGACAGAGTTATGATCACCAGCTGGC
CTTGGAAGAGGGCGAGGGCTGGCGCGCCTGGGGCGTCGTCGCCGGAGCGGCACCCGCGCGTGCAGATGA
AAAGGGACGCTCGCGAGGCCTACGTGCCCAAGCAGAACCTGTTCAGAGACAGGAGCGGCGAGGAGCCCGAG
GAGATGCGCGCGGCCCGGTTCCACGCGGGGCGGGAGCTGCGGCGCGGCCTGGACCGAAAGAGGGTGCTGAG
GGACGAGGATTTCGAGGCGGACGAGCTGACGGGGATCAGCCCCGCGCGCGCACGTGGCCGCGGCCAACC
TGGTCACGGCGTACGAGCAGACCGTGAAGGAGGAGAGCAACTTCCAAAAATCCTTCAACAACCACGTGCGCA
CCCTGATCGCGCGCGAGGAGGTGACCCTGGGCCTGATGCACCTGTGGGACCTGCTGGAGGCCATCGTGCAGA
ACCCCACCAGCAAGCCGCTGACGGCGCAGCTGTTCCTGGTGGTGCAGCATAGTCGGGACAACGAAGCGTTCA
GGGAGGCGCTGCTGAATATCACCGAGCCCGAGGGCCGCTGGCTCCTGGACCTGGTGAACATTCTGCAGAGCA
TCGTGGTGCAGGAGCGCGGGCTGCCGCTGTCCGAGAAGCTGGCGGCCATCAACTTCTCGGTGCTGAGTTTGG
GCAAGTACTACGCTAGGAAGATCTACAAGACCCCGTACGTGCCCATAGACAAGGAGGTGAAGATCGACGGGT
TTTACATGCGCATGACCCTGAAAGTGCTGACCCTGAGCGACGATCTGGGGGTGTACCGCAACGACAGGATGC
ACCGTGCGGTGAGCGCCAGCAGGCGGCGCGAGCTGAGCGACCAGGAGCTGATGCATAGTCTGCAGCGGGCC
CTGACCGGGGCCGGGACCGAGGGGGAGAGCTACTTTGACATGGGCGCGGACCTGCACTGGCAGCCCAGCCGC
CGGGCCTTGGAGGCGGCGGCAGGACCCTACGTAGAAGAGGTGGACGATGAGGTGGACGAGGAGGGCGAGTA
```

-continued

```
CCTGGAAGACTGATGGCGCGACCGTATTTTTGCTAGATGCAACAACAACAGCCACCTCCTGATCCCGCGATGC

GGGCGGCGCTGCAGAGCCAGCCGTCCGGCATTAACTCCTCGGACGATTGGACCCAGGCCATGCAACGCATCA

TGGCGCTGACGACCCGCAACCCCGAAGCCTTTAGACAGCAGCCCCAGGCCAACCGGCTCTCGGCCATCCTGG

AGGCCGTGGTGCCCTCGCGCTCCAACCCCACGCACGAGAAGGTCCTGGCCATCGTGAACGCGCTGGTGGAGA

ACAAGGCCATCCGCGGCGACGAGGCCGGCCTGGTGTACAACGCGCTGCTGGAGCGCGTGGCCCGCTACAACA

GCACCAACGTGCAGACCAACCTGGACCGCATGGTGACCGACGTGCGCGAGGCCGTGGCCCAGCGCGAGCGGT

TCCACCGCGAGTCCAACCTGGGATCCATGGTGGCGCTGAACGCCTTCCTCAGCACCCAGCCCGCCAACGTGCC

CCGGGGCCAGGAGGACTACACCAACTTCATCAGCGCCCTGCGCCTGATGGTGACCGAGGTGCCCCAGAGCGA

GGTGTACCAGTCCGGGCCGGACTACTTCTTCCAGACCAGTCGCCAGGGCTTGCAGACCGTGAACCTGAGCCA

GGCTTTCAAGAACTTGCAGGGCCTGTGGGGCGTGCAGGCCCCGGTCGGGGACCGCGCGACGGTGTCGAGCCT

GCTGACGCCGAACTCGCGCCTGCTGCTGCTGCTGGTGGCCCCCTTCACGGACAGCGGCAGCATCAACCGCAA

CTCGTACCTGGGCTACCTGATTAACCTGTACCGCGAGGCCATCGGCCAGGCGCACGTGGACGAGCAGACCTA

CCAGGAGATCACCCACGTGAGCCGCGCCCTGGGCCAGGACGACCCGGGCAACCTGGAAGCCACCCTGAACTT

TTTGCTGACCAACCGGTCGCAGAAGATCCCGCCCCAGTACGCGCTCAGCACCGAGGAGGAGCGCATCCTGCG

TTACGTGCAGCAGAGCGTGGGCCTGTTCCTGATGCAGGAGGGGGCCACCCCCAGCGCCGCGCTCGACATGAC

CGCGCGCAACATGGAGCCCAGCATGTACGCCAGCAACCGCCCGTTCATCAATAAACTGATGGACTACTTGCA

TCGGGCGGCCGCCATGAACTCTGACTATTTCACCAACGCCATCCTGAATCCCCACTGGCTCCCGCCGCCGGGG

TTCTACACGGGCGAGTACGACATGCCCGACCCCAATGACGGGTTCCTGTGGGACGATGTGGACAGCAGCGTG

TTCTCCCCCCGACCGGGTGCTAACGAGCGCCCCTTGTGGAAGAAGGAAGGCAGCGACCGACGCCCGTCCTCG

GCGCTGTCCGGCCGCGAGGGTGCTGCCGCGGCGGTGCCCGAGGCCGCCAGTCCTTTCCCGAGCTTGCCCTTCT

CGCTGAACAGTATCCGCAGCAGCGAGCTGGGCAGGATCACGCGCCCGCGCTTGCTGGGCGAAGAGGAGTACT

TGAATGACTCGCTGTTGAGACCCGAGCGGGAGAAGAACTTCCCCAATAACGGGATAGAAAGCCTGGTGGACA

AGATGAGCCGCTGGAAGACGTATGCGCAGGAGCACAGGGACGATCCCCGGGCGTCGCAGGGGGCCACGAGC

CGGGGCAGCGCCGCCCGTAAACGCCGGTGGCACGACAGGCAGCGGGGACAGATGTGGGACGATGAGGACTC

CGCCGACGACAGCAGCGTGTTGGACTTGGGTGGGAGTGGTAACCCGTTCGCTCACCTGCGCCCCCGTATCGG

GCGCATGATGTAAGAGAAACCGAAAATAAATGATACTCACCAAGGCCATGGCGACCAGCGTGCGTTCGTTTC

TTCTCTGTTGTTGTTGTATCTAGTATGATGAGGCGTGCGTACCCGGAGGGTCCTCCTCCCTCGTACGAGAGCGT

GATGCAGCAGGCGATGGCGGCGGCGGCGATGCAGCCCCCGCTGGAGGCTCCTTACGTGCCCCCGCGGTACCT

GGCGCCTACGGAGGGGCGGAACAGCATTCGTTACTCGGAGCTGGCACCCTTGTACGATACCACCCGGTTGTA

CCTGGTGGACAACAAGTCGGCGGACATCGCCTCGCTGAACTACCAGAACGACCACAGCAACTTCCTGACCAC

CGTGGTGCAGAACAATGACTTCACCCCCACGGAGGCCAGCACCCAGACCATCAACTTTGACGAGCGCTCGCG

GTGGGGCGGCCAGCTGAAAACCATCATGCACACCAACATGCCCAACGTGAACGAGTTCATGTACAGCAACAA

GTTCAAGGCGCGGGTGATGGTCTCCCGCAAGACCCCCAATGGGGTGACAGTGACAGAGGATTATGATGGTAG

TCAGGATGAGCTGAAGTATGAATGGGTGGAATTTGAGCTGCCCGAAGGCAACTTCTCGGTGACCATGACCAT

CGACCTGATGAACAACGCCATCATCGACAATTACTTGGCGGTGGGCGGCAGAACGGGGTGCTGGAGAGCGA

CATCGGCGTGAAGTTCGACACTAGGAACTTCAGGCTGGGCTGGACCCCGTGACCGAGCTGGTCATGCCCGG

GGTGTACACCAACGAGGCTTTCCATCCCGATATTGTCTTGCTGCCCGGCTGCGGGTGGACTTCACCGAGAGC

CGCCTCAGCAACCTGCTGGGCATTCGCAAGAGGCAGCCCTTCCAGGAAGGCTTCCAGATCATGTACGAGGAT

CTGGAGGGGGCAACATCCCCGCGCTCCTGGATGTCGACGCCTATGAGAAAAGCAAGGAGGATGCAGCAGCT

GAAGCAACTGCAGCCGTAGCTACCGCCTCTACCGAGGTCAGGGGCGATAATTTTGCAAGCGCCGCAGCAGTG
```

-continued

```
GCAGCGGCCGAGGCGGCTGAAACCGAAAGTAAGATAGTCATTCAGCCGGTGGAGAAGGATAGCAAGAACAG

GAGCTACAACGTACTACCGGACAAGATAAACACCGCCTACCGCAGCTGGTACCTAGCCTACAACTATGGCGA

CCCCGAGAAGGGCGTGCGCTCCTGGACGCTGCTCACCACCTCGGACGTCACCTGCGGCGTGGAGCAAGTCTA

CTGGTCGCTGCCCGACATGATGCAAGACCCGGTCACCTTCCGCTCCACGCGTCAAGTTAGCAACTACCCGGTG

GTGGGCGCCGAGCTCCTGCCCGTCTACTCCAAGAGCTTCTTCAACGAGCAGGCCGTCTACTCGCAGCAGCTGC

GCGCCTTCACCTCGCTTACGCACGTCTTCAACCGCTTCCCCGAGAACCAGATCCTCGTCCGCCCGCCCGCGCC

CACCATTACCACCGTCAGTGAAAACGTTCCTGCTCTCACAGATCACGGGACCCTGCCGCTGCGCAGCAGTATC

CGGGGAGTCCAGCGCGTGACCGTTACTGACGCCAGACGCCGCACCTGCCCCTACGTCTACAAGGCCCTGGGC

ATAGTCGCGCCGCGCGTCCTCTCGAGCCGCACCTTCTAAATGTCCATTCTCATCTCGCCCAGTAATAACACCG

GTTGGGGCCTGCGCGCGCCCAGCAAGATGTACGGAGGCGCTCGCCAACGCTCCACGCAACACCCCGTGCGCG

TGCGCGGGCACTTCCGCGCTCCCTGGGGCGCCCTCAAGGGCCGCGTGCGGTCGCGCACCACCGTCGACGACG

TGATCGACCAGGTGGTGGCCGACGCGCGCAACTACACCCCCGCCGCCGCGCCCGTCTCCACCGTGGACGCCG

TCATCGACAGCGTGGTGGCcGACGCGCGCCGGTACGCCCGCGCCAAGAGCCGGCGGCGGCGCATCGCCCGGC

GGCACCGGAGCACCCCCGCCATGCGCGCGGCGCGAGCCTTGCTGCGCAGGGCCAGGCGCACGGGACGCAGG

GCCATGCTCAGGGCGGCCAGACGCGCGGCTTCAGGCGCCAGCGCCGGCAGGACCCGGAGACGCGCGGCCAC

GGCGGCGGCAGCGGCCATCGCCAGCATGTCCCGCCCGCGGCGAGGGAACGTGTACTGGGTGCGCGACGCCGC

CACCGGTGTGCGCGTGCCCGTGCGCACCCGCCCCCCTCGCACTTGAAGATGTTCACTTCGCGATGTTGATGTG

TCCCAGCGGCGAGGAGGATGTCCAAGCGCAAATTCAAGGAAGAGATGCTCCAGGTCATCGCGCCTGAGATCT

ACGGCCCTGCGGTGGTGAAGGAGGAAAGAAAGCCCCGCAAAATCAAGCGGGTCAAAAAGGACAAAAAGGA

AGAAGAAAGTGATGTGGACGGATTGGTGGAGTTTGTGCGCGAGTTCGCCCCCCGGCGGCGCGTGCAGTGGCG

CGGGCGGAAGGTGCAACCGGTGCTGAGACCCGGCACCACCGTGGTCTTCACGCCCGGCGAGCGCTCCGGCAC

CGCTTCCAAGCGCTCCTACGACGAGGTGTACGGGATGATGATATTCTGGAGCAGGCGGCCGAGCGCCTGGG

CGAGTTTGCTTACGGCAAGCGCAGCCGTTCCGCACCGAAGGAAGAGGCGGTGTCCATCCCGCTGGACCACGG

CAACCCCACGCCGAGCCTCAAGCCCGTGACCTTGCAGCAGGTGCTGCCGACCGCGGCGCCGCGCCGGGGGTT

CAAGCGCGAGGGCGAGGATCTGTACCCCACCATGCAGCTGATGGTGCCCAAGCGCCAGAAGCTGGAAGACGT

GCTGGAGACCATGAAGGTGGACCCGGACGTGCAGCCCGAGGTCAAGGTGCGGCCCATCAAGCAGGTGGCCC

CGGGCCTGGGCGTGCAGACCGTGGACATCAAGATTCCCACGGAGCCCATGGAAACGCAGACCGAGCCCATGA

TCAAGCCCAGCACCAGCACCATGGAGGTGCAGACGGATCCCTGGATGCCATCGGCTCCTAGTCGAAGACCCC

GGCGCAAGTACGGCGCGGCCAGCCTGCTGATGCCCAACTACGCGCTGCATCCTTCCATCATCCCCACGCCGGG

CTACCGCGGCACGCGCTTCTACCGCGGTCATACCAGCAGCCGCCGCCGCAAGACCACCACTCGCCGCCGCCG

TCGCCGCACCGCCGCTGCAACCACCCCTGCCGCCCTGGTGCGGAGAGTGTACCGCCGCGGCCGCGCACCTCTG

ACCCTGCCGCGCGCGCGCTACCACCCGAGCATCGCCATTTAAACTTTCGCCtGCTTTGCAGATCAATGGCCCTC

ACATGCCGCCTTCGCGTTCCCATTACGGGCTACCGAGGAAGAAAACCGCGCCGTAGAAGGCTGGCGGGGAAC

GGGATGCGTCGCCACCACCACCGGCGGCGGCGCGCCATCAGCAAGCGGTTGGGGGAGGCTTCCTGCCCGCG

CTGATCCCCATCATCGCCGCGGCGATCGGGGCGATCCCCGGCATTGCTTCCGTGGCGGTGCAGGCCTCTCAGC

GCCACTGAGACACACTTGGAAACATCTTGTAATAAACCaATGGACTCTGACGCTCCTGGTCCTGTGATGTGTTT

TCGTAGACAGATGGAAGACATCAATTTTTCGTCCCTGGCTCCGCGACACGGCACGCGGCCGTTCATGGGCACC

TGGAGCGACATCGGCACCAGCCAACTGAACGGGGCGCCTTCAATTGGAGCAGTCTCTGGAGCGGGCTTAAG

AATTTCGGGTCCACGCTTAAAACCTATGGCAGCAAGGCGTGGAACAGCACCACAGGGCAGGCGCTGAGGGAT

AAGCTGAAAGAGCAGAACTTCCAGCAGAAGGTGGTCGATGGGCTCGCCTCGGGCATCAACGGGGTGGTGGA

CCTGGCCAACCAGGCCGTGCAGCGGCAGATCAACAGCCGCCTGGACCCGGTGCCGCCCGCCGGCTCCGTGGA
```

-continued

```
GATGCCGCAGGTGGAGGAGGAGCTGCCTCCCCTGGACAAGCGGGGCGAGAAGCGACCCCGCCCCGATGCGG

AGGAGACGCTGCTGACGCACACGGACGAGCCGCCCCCGTACGAGGAGGCGGTGAAACTGGGTCTGCCCACC

ACGCGGCCCATCGCGCCCCTGGCCACCGGGGTGCTGAAACCCGAAAAGCCCGCGACCCTGGACTTGCCTCCT

CCCCAGCCTTCCCGCCCCTCTACAGTGGCTAAGCCCCTGCCGCCGGTGGCCGTGGCCCGCGCGCGACCCGGGG

GCACCGCCCGCCCTCATGCGAACTGGCAGAGCACTCTGAACAGCATCGTGGGTCTGGGAGTGCAGAGTGTGA

AGCGCCGCCGCTGCTATTAAACCTACCGTAGCGCTTAACTTGCTTGTCTGTGTGTGTATGTATTATGTCGCCGC

CGCCGCTGTCCACCAGAAGGAGGAGTGAAGAGGCGCGTCGCCGAGTTGCAAGATGGCCACCCCATCGATGCT

GCCCCAGTGGGCGTACATGCACATCGCCGGACAGGACGCTTCGGAGTACCTGAGTCCGGGTCTGGTGCAGTT

TGCCCGCGCCACAGACACCTACTTCAGTCTGGGGAACAAGTTTAGGAACCCCACGGTGGCGCCCACGCACGA

TGTGACCACCGACCGCAGCCAGCGGCTGACGCTGCGCTTCGTGCCCGTGGACCGCGAGGACAACACCTACTC

GTACAAAGTGCGCTACACGCTGGCCGTGGGCGACAACCGCGTGCTGGACATGGCCAGCACCTACTTTGACAT

CCGCGGCGTGCTGGATCGGGGCCCTAGCTTCAAACCCTACTCCGGCACCGCCTACAACAGTCTGGCCCCCAAG

GGAGCACCCAACACTTGTCAGTGGACATATAAAGCCGATGGTGAAACTGCCACAGAAAAAACCTATACATAT

GGAAATGCACCCGTGCAGGGCATTAACATCACAAAAGATGGTATTCAACTTGGAACTGACACCGATGATCAG

CCAATCTACGCAGATAAAACCTATCAGCCTGAACCTCAAGTGGGTGATGCTGAATGGCATGACATCACTGGT

ACTGATGAAAAGTATGGAGGCAGAGCTCTTAAGCCTGATACCAAAATGAAGCCTTGTTATGGTTCTTTTGCCA

AGCCTACTAATAAAGAAGGAGGTCAGGCAAATGTGAAAACAGGAACAGGCACTACTAAAGAATATGACATA

GACATGGCTTTCTTTGACAACAGAAGTGCGGCTGCTGCTGGCCTAGCTCCAGAAATTGTTTTGTATACTGAAA

ATGTGGATTTGGAAACTCCAGATACCCATATTGTATACAAAGCAGGCACAGATGACAGCAGCTCTTCTATTAA

TTTGGGTCAGCAAGCCATGCCCAACAGACCTAACTACATTGGTTTCAGAGACAACTTTATCGGGCTCATGTAC

TACAACAGCACTGGCAATATGGGGGTGCTGGCCGGTCAGGCTTCTCAGCTGAATGCTGTGGTTGACTTGCAAG

ACAGAAACACCGAGCTGTCCTACCAGCTCTTGCTTGACTCTCTGGGTGACAGAACCCGGTATTTCAGTATGTG

GAATCAGGCGGTGGACAGCTATGATCCTGATGTGCGCATTATTGAAAATCATGGTGTGGAGGATGAACTTCC

CAACTATTGTTTCCCTCTGGATGCTGTTGGCAGAACAGATACTTATCAGGGAATTAAGGCTAATGGAACTGAT

CAAACCACATGGACCAAAGATGACAGTGTCAATGATGCTAATGAGATAGGCAAGGGTAATCCATTCGCCATG

GAAATCAACATCCAAGCCAACCTGTGGAGGAACTTCCTCTACGCCAACGTGGCCCTGTACCTGCCCGACTCTT

ACAAGTACACGCCGGCCAATGTTACCCTGCCCACCAACACCAACACCTACGATTACATGAACGGCCGGGTGG

TGGCGCCCTCGCTGGTGGACTCCTACATCAACATCGGGGCGCGCTGGTCGCTGGATCCCATGGACAACGTGA

ACCCCTTCAACCACCACCGCAATGCGGGGCTGCGCTACCGCTCCATGCTCCTGGGCAACGGGCGCTACGTGCC

CTTCCACATCCAGGTGCCCCAGAAATTTTTCGCCATCAAGAGCCTCCTGCTCCTGCCCGGGTCCTACACCTAC

GAGTGGAACTTCCGCAAGGACGTCAACATGATCCTGCAGAGCTCCCTCGGCAACGACCTGCGCACGGACGGG

GCCTCCATCTCCTTCACCAGCATCAACCTCTACGCCACCTTCTTCCCCATGGCGCACAACACGGCCTCCACGCT

CGAGGCCATGCTGCGCAACGACACCAACGACCAGTCCTTCAACGACTACCTCTCGGCGGCCAACATGCTCTA

CCCCATCCCGGCCAACGCCACCAACGTGCCCATCTCCATCCCCTCGCGCAACTGGGCCGCCTTCCGCGGCTGG

TCCTTCACGCGTCTCAAGACCAAGGAGACGCCCTCGCTGGGCTCCGGGTTCGACCCCTACTTCGTCTACTCGG

GCTCCATCCCCTACCTCGACGGCACCTTCTACCTCAACCACACCTTCAAGAAGGTCTCCATCACCTTCGACTCC

TCCGTCAGCTGGCCCGGCAACGACCGGCTCCTGACGCCCAACGAGTTCGAAATCAAGCGCACCGTCGACGGC

GAGGGCTACAACGTGGCCCAGTGCAACATGACCAAGGACTGGTTCCTGGTCCAGATGCTGGCCCACTACAAC

ATCGGCTACCAGGGCTTCTACGTGCCCGAGGGCTACAAGGACCGCATGTACTCCTTCTTCCGCAACTTCCAGC

CCATGAGCCGCCAGGTGGTGGACGAGGTCAACTACAAGGACTACCAGGCCGTCACCCTGGCCTACCAGCACA
```

-continued
ACAACTCGGGCTTCGTCGGCTACCTCGCGCCCACCATGCGCCAGGGCCAGCCCTACCCCGCCAACTACCCCTA
CCCGCTCATCGGCAAGAGCGCCGTCACCAGCGTCACCCAGAAAAAGTTCCTCTGCGACAGGGTCATGTGGCG
CATCCCCTTCTCCAGCAACTTCATGTCCATGGGCGCGCTCACCGACCTCGGCCAGAACATGCTCTATGCCAAC
TCCGCCCACGCGCTAGACATGAATTTCGAAGTCGACCCCATGGATGAGTCCACCCTTCTCTATGTTGTCTTCG
AAGTCTTCGACGTCGTCCGAGTGCACCAGCCCCACCGCGGCGTCATCGAGGCCGTCTACCTGCGCACCCCCTT
CTCGGCCGGTAACGCCACCACCTAAGCTCTTGCTTCTTGCAAGCCATGGCCGCGGGCTCCGGCGAGCAGGAG
CTCAGGGCCATCATCCGCGACCTGGGCTGCGGGCCCTACTTCCTGGGCACCTTCGATAAGCGCTTCCCGGGAT
TCATGGCCCCGCACAAGCTGGCCTGCGCCATCGTCAACACGGCCGGCCGCGAGACCGGGGGCGAGCACTGGC
TGGCCTTCGCCTGGAACCCGCGCTCGAACACCTGCTACCTCTTCGACCCCTTCGGGTTCTCGGACGAGCGCCT
CAAGCAGATCTACCAGTTCGAGTACGAGGGCCTGCTGCGCCGCAGCGCCCTGGCCACCGAGGACCGCTGCGT
CACCCTGGAAAAGTCCACCCAGACCGTGCAGGGTCCGCGCTCGGCCGCCTGCGGGCTCTTCTGCTGCATGTTC
CTGCACGCCTTCGTGCACTGGCCCGACCGCCCCATGGACAAGAACCCCACCATGAACTTGCTGACGGGGGTG
CCCAACGGCATGCTCCAGTCGCCCCAGGTGGAACCCACCCTGCGCCGCAACCAGGAGGCGCTCTACCGCTTC
CTCAACTCCCACTCCGCCTACTTTCGCTCCCACCGCGCGCGCATCGAGAAGGCCACCGCCTTCGACCGCATGA
ATCAAGACATGTAAACCGTGTGTGTATGTTAAATGTCTTTAATAAACAGCACTTTCATGTTACACATGCATCT
GAGATGATTTATTTAGAAATCGAAAGGGTTCTGCCGGGTCTCGGCATGGCCCGCGGGCAGGGACACGTTGCG
GAACTGGTACTTGGCCAGCCACTTGAACTCGGGGATCAGCAGTTTGGGCAGCGGGGTGTCGGGGAAGGAGTC
GGTCCACAGCTTCCGCGTCAGTTGCAGGGCGCCCAGCAGGTCGGCGCGGAGATCTTGAAATCGCAGTTGGG
ACCCGCGTTCTGCGCGCGGGAGTTGCGGTACACGGGGTTGCAGCACTGGAACACCATCAGGGCCGGGTGCTT
CACGCTCGCCAGCACCGTCGCGTCGGTGATGCTCTCCACGTCGAGGTCCTCGGCGTTGGCCATCCCGAAGGGG
GTCATCTTGCAGGTCTGCCTTCCCATGGTGGGCACGCACCCGGGCTTGTGGTTGCAATCGCAGTGCAGGGGA
TCAGCATCATCTGGGCCTGGTCGGCGTTCATCCCCGGGTACATGGCCTTCATGAAAGCCTCCAATTGCCTGAA
CGCCTGCTGGGCCTTGGCTCCCTCGGTGAAGAAGACCCCGCAGGACTTGCTAGAGAACTGGTTGGTGGCGCA
CCCGGCGTCGTGCACGCAGCAGCGCGCGTCGTTGTTGGCCAGCTGCACCACGCTGCGCCCCCAGCGGTTCTGG
GTGATCTTGGCCCGGTCGGGGTTCTCCTTCAGCGCGCGCTGCCCGTTCTCGCTCGCCACATCCATCTCGATCAT
GTGCTCCTTCTGGATCATGGTGGTCCCGTGCAGGCACCGCAGCTTGCCCTCGGCCTCGGTGCACCCGTGCAGC
CACAGCGCGCACCCGGTGCACTCCCAGTTCTTGTGGGCGATCTGGGAATGCGCGTGCACGAAGCCCTGCAGG
AAGCGGCCCATCATGGTGGTCAGGGTCTTGTTGCTAGTGAAGGTCAGCGGAATGCCGCGGTGCTCCTCGTTGA
TGTACAGGTGGCAGATGCGGCGGTACACCTCGCCCTGCTCGGGCATCAGCTGGAAGTTGGCTTTCAGGTCGGT
CTCCACGCGGTAGCGGTCCATCAGCATAGTCATGATTTCCATACCCTTCTCCCAGGCCGAGACGATGGGCAGG
CTCATAGGGTTCTTCACCATCATCTTAGCGCTAGCAGCCGCGGCCAGGGGGTCGCTCTCGTCCAGGGTCTCAA
AGCTCCGCTTGCCGTCCTTCTCGGTGATCCGCACCGGGGGGTAGCTGAAGCCCACGGCCGCCAGCTCCTCCTC
GGCCTGTCTTTCGTCCTCGCTGTCCTGGCTGACGTCCTGCAGGACCACATGCTTGGTCTTGCGGGGTTTCTTCT
TGGGCGGCAGCGGCGGCGGAGATGTTGGAGATGGCGAGGGGGAGCGCGAGTTCTCGCTCACCACTACTATCT
CTTCCTCTTCTTGGTCCGAGGCCACGCGGCGGTAGGTATGTCTCTTCGGGGCAGAGGCGGAGGCGACGGGCT
CTCGCCGCCGCGACTTGGCGGATGGCTGGCAGAGCCCCTTCCGCGTTCGGGGGTGCGCTCCCGGCGGCGCTCT
GACTGACTTCCTCCGCGGCCGGCCATTGTGTTCTCCTAGGGAGGAACAACAAGCATGGAGACTCAGCCATCG
CCAACCTCGCCATCTGCCCCCACCGCCGACGAGAAGCAGCAGCAGCGAGAATGAAAGCTTAACCGCCCCGCCG
CCCAGCCCCGCCACCTCCGACGCGGCCGTCCCAGACATGCAAGAGATGGAGGAATCCATCGAGATTGACCTG
GGCTATGTGACGCCCGCGGAGCACGAGGAGGAGCTGGCAGTGCGCTTTTCACAAGAAGAGATACACCAAGA
ACAGCCAGAGCAGGAAGCAGAGAATGAGCAGAGTCAGGCTGGGCTCGAGCATGACGGCGACTACCTCCACC -continued

```
TGAGCGGGGGGAGGACGCGCTCATCAAGCATCTGGCCCGGCAGGCCACCATCGTCAAGGATGCGCTGCTCG

ACCGCACCGAGGTGCCCCTCAGCGTGGAGGAGCTCAGCCGCGCCTACGAGTTGAACCTCTTCTCGCCGCGCGT

GCCCCCCAAGCGCCAGCCCAATGGCACCTGCGAGCCCAACCCGCGCCTCAACTTCTACCCGGTCTTCGCGGTG

CCCGAGGCCCTGGCCACCTACCACATCTTTTTCAAGAACCAAAAGATCCCCGTCTCCTGCCGCGCCAACCGCA

CCCGCGCCGACGCCCTTTTCAACCTGGGTCCCGGCGCCCGCCTACCTGATATCGCCTCCTTGGAAGAGGTTCC

CAAGATCTTCGAGGGTCTGGGCAGCGACGAGACTCGGGCCGCGAACGCTCTGCAAGGAGAAGGAGGAGAGC

ATGAGCACCACAGCGCCCTGGTCGAGTTGGAAGGCGACAACGCGCGGCTGGCGGTGCTCAAACGCACGGTCG

AGCTGACCCATTTCGCCTACCCGGCTCTGAACCTGCCCCCCAAAGTCATGAGCGCGGTCATGGACCAGGTGCT

CATCAAGCGCGCGTCGCCCATCTCCGAGGACGAGGGCATGCAAGACTCCGAGGAGGGCAAGCCCGTGGTCAG

CGACGAGCAGCTGGCCCGGTGGCTGGGTCCTAATGCTAGTCCCCAGAGTTTGGAAGAGCGGCGCAAACTCAT

GATGGCCGTGGTCCTGGTGACCGTGGAGCTGGAGTGCCTGCGCCGCTTCTTCGCCGACGCGGAGACCCTGCGC

AAGGTCGAGGAGAACCTGCACTACCTCTTCAGGCACGGGTTCGTGCGCCAGGCCTGCAAGATCTCCAACGTG

GAGCTGACCAACCTGGTCTCCTACATGGGCATCTTGCACGAGAACCGCCTGGGGCAGAACGTGCTGCACACC

ACCCTGCGCGGGGAGGCCCGGCGCGACTACATCCGCGACTGCGTCTACCTCTACCTCTGCCACACCTGGCAGA

CGGGCATGGGCGTGTGGCAGCAGTGTCTGGAGGAGCAGAACCTGAAAGAGCTCTGCAAGCTCCTGCAGAAG

AACCTCAAGGGTCTGTGGACCGGGTTCGACGAGCGCACCACCGCCTCGGACCTGGCCGACCTCATTTTCCCCG

AGCGCCTCAGGCTGACGCTGCGCAACGGCCTGCCCGACTTTATGAGCCAAAGCATGTTGCAAAACTTTCGCTC

TTTCATCCTCGAACGCTCCGGAATCCTGCCCGCCACCTGCTCCGCGCTGCCCTCGGACTTCGTGCCGCTGACCT

TCCGCGAGTGCCCCCCGCCGCTGTGGAGCCACTGCTACCTGCTGCGCCTGGCCAACTACCTGGCCTACCACTC

GGACGTGATCGAGGACGTCAGCGGCGAGGGCCTGCTCGAGTGCCACTGCCGCTGCAACCTCTGCACGCCGCA

CCGCTCCCTGGCCTGCAACCCCCAGCTGCTGAGCGAGACCCAGATCATCGGCACCTTCGAGTTGCAAGGGCCC

AGCGAAGGCGAGGGTTCAGCCGCCAAGGGGGGTCTGAAACTCACCCCGGGGCTGTGGACCTCGGCCTACTTG

CGCAAGTTCGTGCCCGAGGACTACCATCCCTTCGAGATCAGGTTCTACGAGGACCAATCCCATCCGCCCAAGG

CCGAGCTGTCGGCCTGCGTCATCACCCAGGGGGCGATCCTGGCCCAATTGCAAGCCATCCAGAAATCCCGCC

AAGAATTCTTGCTGAAAAAGGGCCGCGGGTCTACCTCGACCCCCAGACCGGTGAGGAGCTCAACCCCGGCT

TCCCCCAGGATGCCCCGAGGAAACAAGAAGCTGAAAGTGGAGCTGCCGCCCGTGGAGGATTTGGAGGAAGA

CTGGGAGAACAGCAGTCAGGCGAGAGGAGGAGGAGATGGAGGAAGACTGGGACAGCACTCAGGCAGAGGAG

GACAGCCTGCAAGACAGTCTGGAGGAAGACGAGGAGGAGGCAGAGGAGGAGGTGGAAGAAGCAGCCGCCG

CCAGACCGTCGTCCTCGGCGGGGAGAAAGCAAGCAGCACGGATACCATCTCCGCTCCGGGTCGGGGTCCCG

CTCGACCACACAGTAGATGGGACGAGACCGGACGATTCCCGAACCCCACCACCCAGACCGGTAAGAAGGAG

CGGCAGGGATACAAGTCCTGGCGGGGGCACAAAAACGCCATCGTCTCCTGCTTGCAGGCCTGCGGGGCAAC

ATCTCCTTCACCCGGCGCTACCTGCTCTTCCACCGCGGGGTGAACTTTCCCCGCAACATCTTGCATTACTACCG

TCACCTCCACAGCCCCTACTACTTCCAAGAAGAGGCAGCAGCAGCAGAAAAAGACCAGCAGAAAACCAGCA

GCTAGAAAATCCACAGCGGCGGCAGCAGGTGGACTGAGGATCGCGGCGAACGAGCCGGCGCAAACCCGGGA

GCTGAGGAACCGGATCTTTCCCACCCTCTATGCCATCTTCCAGCAGAGTCGGGGCAGGAGCAGGAACTGAA

AGTCAAGAACCGTTCTCTGCGCTCGCTCACCCGCAGTTGTCTGTATCACAAGAGCGAAGACCAACTTCAGCGC

ACTCTCGAGGACGCCGAGGCTCTCTTCAACAAGTACTGCGCGCTCACTCTTAAAGAGTAGCCCGCGCCCGCCC

AGTCGCAGAAAAGGCGGGAATTACGTCACCTGTGCCCTTCGCCCTAGCCGCCTCCACCCATCATCATGAGCA

AAGAGATTCCCACGCCTTACATGTGGAGCTACCAGCCCCAGATGGGCCTGGCCGCCGGTGCCGCCCAGGACT

ACTCCACCCGCATGAATTGGCTCAGCGCCGGGCCCGCGATGATCTCACGGGTGAATGACATCCGCGCCCACC
```

-continued

GAAACCAGATACTCCTAGAACAGTCAGCGCTCACCGCCACGCCCCGCAATCACCTCAATCCGCGTAATTGGC

CCGCCGCCCTGGTGTACCAGGAAATTCCCCAGCCCACGACCGTACTACTTCCGCGAGACGCCCAGGCCGAAG

TCCAGCTGACTAACTCAGGTGTCCAGCTGGCGGGCGGCGCCACCCTGTGTCGTCACCGCCCCGCTCAGGGTAT

AAAGCGGCTGGTGATCCGGGGCAGAGGCACACAGCTCAACGACGAGGTGGTGAGCTCTTCGCTGGGTCTGCG

ACCTGACGGAGTCTTCCAACTCGCCGGATCGGGGAGATCTTCCTTCACGCCTCGTCAGGCCGTCCTGACTTTG

GAGAGTTCGTCCTCGCAGCCCCGCTCGGGTGGCATCGGCACTCTCCAGTTCGTGGAGGAGTTCACTCCCTCGG

TCTACTTCAACCCCTTCTCCGGCTCCCCCGGCCACTACCCGGACGAGTTCATCCCGAACTTCGACGCCATCAG

CGAGTCGGTGGACGGCTACGATTGAAACTAATCACCCCCTTATCCAGTGAAATAAAGATCATATTGATGATG

ATTTTACAGAAATAAAAATAATCATTTGATTTGAAATAAAGATACAATCATATTGATGATTTGAGTTTAACA

AAAAAATAAAGAATCACTTACTTGAAATCTGATACCAGGTCTCTGTCCATGTTTTCTGCCAACACCACTTCAC

TCCCCTCTTCCCAGCTCTGGTACTGCAGGCCCCGGCGGGCTGCAAACTTCCTCCACACGCTGAAGGGGATGTC

AAATTCCTCCTGTCCCTCAATCTTCATTTTATCTTCTATCAGATGTCCAAAAAGCGCGTCCGGGTGGATGATGA

CTTCGACCCCGTCTACCCCTACGATGCAGACAACGCACCGACCGTGCCCTTCATCAACCCCCCCTTCGTCTCTT

CAGATGGATTCCAAGAGAAGCCCCTGGGGGTGTTGTCCCTGCGACTGGCCGACCCCGTCACCACCAAGAACG

GGGAAATCACCCTCAAGCTGGGAGAGGGGGTGGACCTCGATTCCTCGGGAAAACTCATCTCCAACACGGCCA

CCAAGGCCGCCGCCCCTCTCAGTTTTTCCAACAACACCATTTCCCTTAACATGGATCACCCCTTTTACACTAAA

GATGGAAAATTATCCTTACAAGTTTCTCCACCATTAAATATACTGAGAACAAGCATTCTAAACACACTAGCTT

TAGGTTTTGGATCAGGTTTAGGACTCCGTGGCTCTGCCTTGGCAGTACAGTTAGTCTCTCCACTTACATTTGAT

ACTGATGGAAACATAAAGCTTACCTTAGACAGAGGTTTGCATGTTACAACAGGAGATGCAATTGAAAGCAAC

ATAAGCTGGGCTAAAGGTTTAAAATTTGAAGATGGAGCCATAGCAACCAACATTGGAAATGGGTTAGAGTTT

GGAAGCAGTAGTACAGAAACAGGTGTTGATGATGCTTACCCAATCCAAGTTAAACTTGGATCTGGCCTTAGCT

TTGACAGTACAGGAGCCATAATGGCTGGTAACAAAGAAGACGATAAACTCACTTTGTGGACAACACCTGATC

CATCACCAAACTGTCAAATACTCGCAGAAAATGATGCAAAACTAACACTTTGCTTGACTAAATGTGGTAGTCA

AATACTGGCCACTGTGTCAGTCTTAGTTGTAGGAAGTGGAAACCTAAACCCCATTACTGGCACCGTAAGCAGT

GCTCAGGTGTTTCTACGTTTTGATGCAAACGGTGTTCTTTTAACAGAACATTCTACACTAAAAAAATACTGGG

GGTATAGGCAGGGAGATAGCATAGATGGCACTCCATATACCAATGCTGTAGGATTCATGCCCAATTTAAAAG

CTTATCCAAAGTCACAAAGTTCTACTACTAAAAATAATATAGTAGGGCAAGTATACATGAATGGAGATGTTTC

AAAACCTATGCTTCTCACTATAACCCTCAATGGTACTGATGACAGCAACAGTACATATTCAATGTCATTTTCA

TACACCTGGACTAATGGAAGCTATGTTGGAGCAACATTTGGGGCTAACTCTTATACCTTCTCATACATCGCCC

AAGAATGAACACTGTATCCCACCCTGCATGCCAACCCTTCCCACCCCACTCTGTGGAACAAACTCTGAAACAC

AAAATAAAATAAAGTTCAAGTGTTTTATTGATTCAACAGTTTTACAGGATTCGAGCAGTTATTTTTCCTCCACC

CTCCCAGGACATGGAATACACCACCCTCTCCCCCCGCACAGCCTTGAACATCTGAATGCCATTGGTGATGGAC

ATGCTTTTGGTCTCCACGTTCCACACAGTTTCAGAGCGAGCCAGTCTCGGGTCGGTCAGGGAGATGAAACCCT

CCGGGCACTCCCGCATCTGCACCTCACAGCTCAACAGCTGAGGATTGTCCTCGGTGGTCGGGATCACGGTTAT

CTGGAAGAAGCAGAAGAGCGGCGGTGGGAATCATAGTCCGCGAACGGGATCGGCCGGTGGTGTCGCATCAG

GCCCCGCAGCAGTCGCTGCCGCCGCCGCTCCGTCAAGCTGCTGCTCAGGGGGTCCGGGTCCAGGGACTCCCTC

AGCATGATGCCCACGGCCCTCAGCATCAGTCGTCGGTGCGGCGGGCGCAGCAGCGCATGCGGATCTCGCTC

AGGTCGCTGCAGTACGTGCAACACAGAACCACCAGGTTGTTCAACAGTCCATAGTTCAACACGCTCCAGCCG

AAACTCATCGCGGGAAGGATGCTACCCACGTGGCCGTCGTACCAGATCCTCAGGTAAATCAAGTGGTGCCCC

CTCCAGAACACGCTGCCCACGTACATGATCTCCTTGGGCATGTGGCGGTTCACCACCTCCCGGTACCACATCA

CCCTCTGGTTGAACATGCAGCCCCGGATGATCCTGCGGAACCACAGGGCCAGCACCGCCCCGCCCGCCATGC

-continued

```
AGCGAAGAGACCCCGGGTCCCGGCAATGGCAATGGAGGACCCACCGCTCGTACCCGTGGATCATCTGGGAGC

TGAACAAGTCTATGTTGGCACAGCACAGGCATATGCTCATGCATCTCTTCAGCACTCTCAACTCCTCGGGGT

CAAAACCATATCCCAGGGCACGGGGAACTCTTGCAGGACAGCGAACCCCGCAGAACAGGGCAATCCTCGCAC

AGAACTTACATTGTGCATGGACAGGGTATCGCAATCAGGCAGCACCGGGTGATCCTCCACCAGAGAAGCGCG

GGTCTCGGTCTCCTCACAGCGTGGTAAGGGGGCCGGCCGATACGGGTGATGGCGGGACGCGGCTGATCGTGT

TCGCGACCGTGTCATGATGCAGTTGCTTTCGGACATTTTCGTACTTGCTGTAGCAGAACCTGGTCCGGGCGCT

GCACACCGATCGCCGGCGGCGGTCTCGGCGCTTGGAACGCTCGGTGTTGAAATTGTAAAACAGCCACTCTCTC

AGACCGTGCAGCAGATCTAGGGCCTCAGGAGTGATGAAGATCCCATCATGCCTGATGGCTCTGATCACATCG

ACCACCGTGGAATGGGCCAGACCCAGCCAGATGATGCAATTTTGTTGGGTTTCGGTGACGGCGAGCCTCGGG

AACAACGATGAAGTAAATGCAAGCGGTGCGTTCCAGCATGGTTAGTTAGCTGATCTGTAGAAAAACAAAAA

TGAACATTAAACCATGCTAGCCTGGCGAACAGGTGGGTAAATCGTTCTCTCCAGCACCAGGCAGGCCACGGG

GTCTCCGGCGCGACCCTCGTAAAAATTGTCGCTATGATTGAAAACCATCACAGAGAGACGTTCCCGGTGGCC

GGCGTGAATGATTCGACAAGATGAATACACCCCCGGAACATTGGCGTCCGCGAGTGAAAAAAAGCGCCCGA

GGAAGCAATAAGGCACTACAATGCTCAGTCTCAAGTCCAGCAAAGCGATGCCATGCGGATGAAGCACAAAAT

TCTCAGGTGCGTACAAAATGTAATTACTCCCCTCCTGCACAGGCAGCAAAGCCCCGATCCCTCCAGGTACAC

ATACAAAGCCTCAGCGTCCATAGCTTACCGAGCAGCAGCACACAACAGGCGCAAGAGTCAGAGAAAGGCTG

AGCTCTAACCTGTCCACCCGCTCTCTGCTCAATATATAGCCCAGATCTACACTGACGTAAAGGCCAAAGTCTA

AAAATACCCGCCAAATAATCACACACGCCCAGCACACGCCCAGAAACCGGTGACACACTCAAAAAAATACG

CGCACTTCCTCAAACGCCCAAAACTGCCGTCATTTCCGGGTTCCCACGCTACGTCATCAAAACACGACTTTCA

AATTCCGTCGACCGTTAAAAACGTCACCCGCCCCGCCCCTAACGGTCGCCCGTCTCTCAGCCAATCAGCGCCC

CGCATCCCCAAATTCAAACACCTCATTTGCATATTAACGCGCACAAAAAGTTTGAGGTATATTATTGATGATG
```

REFERENCES

1. Desrichard, A., Snyder, A. & Chan, T. A. Cancer Neoantigens and Applications for Immunotherapy. *Clin. Cancer Res. Off. J. Am. Assoc. Cancer Res.* (2015). doi:10.1158/1078-0432.CCR-14-3175
2. Schumacher, T. N. & Schreiber, R. D. Neoantigens in cancer immunotherapy. *Science* 348, 69-74 (2015).
3. Gubin, M. M., Artyomov, M. N., Mardis, E. R. & Schreiber, R. D. Tumor neoantigens: building a framework for personalized cancer immunotherapy. *J. Clin. Invest.* 125, 3413-3421(2015).
4. Rizvi, N. A. et al. Cancer immunology. Mutational landscape determines sensitivity to PD-1 blockade in non-small cell lung cancer. *Science* 348, 124-128 (2015).
5. Snyder, A. et al. Genetic basis for clinical response to CTLA-4 blockade in melanoma. *N. Engl. J. Med.* 371, 2189-2199 (2014).
6. Carreno, B. M. et al. Cancer immunotherapy. A dendritic cell vaccine increases the breadth and diversity of melanoma neoantigen-specific T cells. *Science* 348, 803-808 (2015).
7. Tran, E. et al. Cancer immunotherapy based on mutation-specific CD4+ T cells in a patient with epithelial cancer. *Science* 344, 641-645 (2014).
8. Hacohen, N. & Wu, C. J.-Y. United States Patent Application: 20110293637—COMPOSITIONS AND METHODS OF IDENTIFYING TUMOR SPECIFIC NEOANTIGENS. (A1). at <appft1.uspto.gov/netacgi/nph-Parser?Sect1=PTO1&Sect2=HITOFF&d=PG01&p=1&u=/netahtml/PTO/srchnum.html&r=1&f=G&l=50&s1=20110293637.PGNR.>
9. Lundegaard, C., Hoof, I., Lund, O. & Nielsen, M. State of the art and challenges in sequence based T-cell epitope prediction. *Immunome Res.* 6 Suppl 2, S3 (2010).
10. Yadav, M. et al. Predicting immunogenic tumour mutations by combining mass spectrometry and exome sequencing. *Nature* 515, 572-576 (2014).
11. Bassani-Sternberg, M., Pletscher-Frankild, S., Jensen, L. J. & Mann, M. Mass spectrometry of human leukocyte antigen class I peptidomes reveals strong effects of protein abundance and turnover on antigen presentation. *Mol. Cell. Proteomics MCP* 14, 658-673 (2015).
12. Van Allen, E. M. et al. Genomic correlates of response to CTLA-4 blockade in metastatic melanoma. *Science* 350, 207-211 (2015).
13. Yoshida, K. & Ogawa, S. Splicing factor mutations and cancer. *Wiley Interdiscip. Rev. RNA* 5, 445-459 (2014).
14. Cancer Genome Atlas Research Network. Comprehensive molecular profiling of lung adenocarcinoma. *Nature* 511, 543-550 (2014).
15. Rajasagi, M. et al. Systematic identification of personal tumor-specific neoantigens in chronic lymphocytic leukemia. *Blood* 124, 453-462 (2014).
16. Downing, S. R. et al. United States Patent Application: 0120208706—OPTIMIZATION OF MULTIGENE ANALYSIS OF TUMOR SAMPLES. (A1). at <appft1.uspto.gov/netacgi/nph-Parser?Sect1=PTO1&Sect2=HITOFF&d=PG01&p=1&u=/netahtml/PTO/srchnum.html&r=1&f=G&l=50&s1=20120208706.PGNR.>

17. Target Capture for NextGen Sequencing—IDT. at world wide web at idtdna.com/pages/products/nextgen/target-capture
18. Shukla, S. A. et al. Comprehensive analysis of cancer-associated somatic mutations in class I HLA genes. *Nat. Biotechnol.* 33, 1152-1158 (2015).
19. Cieslik, M. et al. The use of exome capture RNA-seq for highly degraded RNA with application to clinical cancer sequencing. *Genome Res.* 25, 1372-1381 (2015).
20. Bodini, M. et al. The hidden genomic landscape of acute myeloid leukemia: subclonal structure revealed by undetected mutations. *Blood* 125, 600-605 (2015).
21. Saunders, C. T. et al. Strelka: accurate somatic small-variant calling from sequenced tumor-normal sample pairs. *Bioinforma. Oxf. Engl.* 28, 1811-1817 (2012).
22. Cibulskis, K. et al. Sensitive detection of somatic point mutations in impure and heterogeneous cancer samples. *Nat. Biotechnol.* 31, 213-219 (2013).
23. Wilkerson, M. D. et al. Integrated RNA and DNA sequencing improves mutation detection in low purity tumors. *Nucleic Acids Res.* 42, e107 (2014).
24. Mose, L. E., Wilkerson, M. D., Hayes, D. N., Perou, C. M. & Parker, J. S. ABRA: improved coding indel detection via assembly-based realignment. *Bioinforma. Oxf Engl.* 30, 2813-2815 (2014).
25. Ye, K., Schulz, M. H., Long, Q., Apweiler, R. & Ning, Z. Pindel: a pattern growth approach to detect break points of large deletions and medium sized insertions from paired-end short reads. *Bioinforma. Oxf. Engl.* 25, 2865-2871 (2009).
26. Lam, H. Y. K. et al. Nucleotide-resolution analysis of structural variants using BreakSeq and a breakpoint library. *Nat. Biotechnol.* 28, 47-55 (2010).
27. Frampton, G. M. et al. Development and validation of a clinical cancer genomic profiling test based on massively parallel DNA sequencing. *Nat. Biotechnol.* 31, 1023-1031 (2013).
28. Boegel, S. et al. HLA typing from RNA-Seq sequence reads. *Genome Med.* 4, 102 (2012).
29. Liu, C. et al. ATHLATES: accurate typing of human leukocyte antigen through exome sequencing. *Nucleic Acids Res.* 41, e142 (2013).
30. Mayor, N. P. et al. HLA Typing for the Next Generation. *PloS One* 10, e0127153 (2015).
31. Roy, C. K., Olson, S., Graveley, B. R., Zamore, P. D. & Moore, M. J. Assessing long-distance RNA sequence connectivity via RNA-templated DNA-DNA ligation. *eLife* 4, (2015).
32. Song, L. & Florea, L. CLASS: constrained transcript assembly of RNA-seq reads. *BMC Bioinformatics* 14 Suppl 5, S14 (2013).
33. Maretty, L., Sibbesen, J. A. & Krogh, A. Bayesian transcriptome assembly. *Genome Biol.* 15, 501 (2014).
34. Pertea, M. et al. StringTie enables improved reconstruction of a transcriptome from RNA-seq reads. *Nat. Biotechnol.* 33, 290-295 (2015).
35. Roberts, A., Pimentel, H., Trapnell, C. & Pachter, L. Identification of novel transcripts in annotated genomes using RNA-Seq. *Bioinforma. Oxf. Engl.* (2011). doi:10.1093/bioinformatics/btr355
36. Vitting-Seerup, K., Porse, B. T., Sandelin, A. & Waage, J. spliceR: an R package for classification of alternative splicing and prediction of coding potential from RNA-seq data. *BMC Bioinformatics* 15, 81 (2014).
37. Rivas, M. A. et al. Human genomics. Effect of predicted protein-truncating genetic variants on the human transcriptome. *Science* 348, 666-669 (2015).
38. Skelly, D. A., Johansson, M., Madeoy, J., Wakefield, J. & Akey, J. M. A powerful and flexible statistical framework for testing hypotheses of allele-specific gene expression from RNA-seq data. *Genome Res.* 21, 1728-1737 (2011).
39. Anders, S., Pyl, P. T. & Huber, W. HTSeq—a Python framework to work with high-throughput sequencing data. *Bioinforma. Oxf. Engl.* 31, 166-169 (2015).
40. Furney, S. J. et al. SF3B1 mutations are associated with alternative splicing in uveal melanoma. *Cancer Discov.* (2013). doi:10.1158/2159-8290.CD-13-0330
41. Zhou, Q. et al. A chemical genetics approach for the functional assessment of novel cancer genes. *Cancer Res.* (2015). doi:10.1158/0008-5472.CAN-14-2930
42. Maguire, S. L. et al. SF3B1 mutations constitute a novel therapeutic target in breast cancer. *J. Pathol.* 235, 571-580 (2015).
43. Carithers, L. J. et al. A Novel Approach to High-Quality Postmortem Tissue Procurement: The GTEx Project. *Biopreservation Biobanking* 13, 311-319 (2015).
44. Xu, G. et al. RNA CoMPASS: a dual approach for pathogen and host transcriptome analysis of RNA-seq datasets. *PloS One* 9, e89445 (2014).
45. Andreatta, M. & Nielsen, M. Gapped sequence alignment using artificial neural networks: application to the MHC class I system. *Bioinforma. Oxf. Engl.* (2015). doi:10.1093/bioinformatics/btv639
46. Jørgensen, K. W., Rasmussen, M., Buus, S. & Nielsen, M. NetMHCstab-predicting stability of peptide-MHC-I complexes; impacts for cytotoxic T lymphocyte epitope discovery. *Immunology* 141, 18-26 (2014).
47. Larsen, M. V. et al. An integrative approach to CTL epitope prediction: a combined algorithm integrating MHC class I binding, TAP transport efficiency, and proteasomal cleavage predictions. *Eur. J. Immunol.* 35, 2295-2303 (2005).
48. Nielsen, M., Lundegaard, C., Lund, O. & Keşmir, C. The role of the proteasome in generating cytotoxic T-cell epitopes: insights obtained from improved predictions of proteasomal cleavage. *Immunogenetics* 57, 33-41 (2005).
49. Boisvert, F.-M. et al. A Quantitative Spatial Proteomics Analysis of Proteome Turnover in Human Cells. *Mol. Cell. Proteomics* 11, M111.011429-M111.011429 (2012).
50. Duan, F. et al. Genomic and bioinformatic profiling of mutational neoepitopes reveals new rules to predict anti-cancer immunogenicity. *J. Exp. Med.* 211, 2231-2248 (2014).
51. Janeway's Immunobiology: 9780815345312: Medicine & Health Science Books @ Amazon.com. at world wide web at amazon.com/Janeways-Immunobiology-Kenneth-Murphy/dp/0815345313
52. Calis, J. J. A. et al. Properties of MHC Class I Presented Peptides That Enhance Immunogenicity. *PLoS Comput. Biol.* 9, e1003266 (2013).
53. Zhang, J. et al. Intratumor heterogeneity in localized lung adenocarcinomas delineated by multiregion sequencing. *Science* 346, 256-259 (2014)
54. Walter, M. J. et al. Clonal architecture of secondary acute myeloid leukemia. *N. Engl. J. Med.* 366, 1090-1098 (2012).
55. Hunt D F, Henderson R A, Shabanowitz J, Sakaguchi K, Michel H, Sevilir N, Cox A L, Appella E, Engelhard V H. Characterization of peptides bound to the class I MHC molecule HLA-A2.1 by mass spectrometry. Science 1992. 255: 1261-1263.
56. Zarling A L, Polefrone J M, Evans A M, Mikesh L M, Shabanowitz J, Lewis S T, Engelhard V H, Hunt D F.

Identification of class I MHC-associated phosphopeptides as targets for cancer immunotherapy. Proc Natl Acad Sci USA. 2006 Oct. 3; 103(40):14889-94.
57. Bassani-Sternberg M, Pletscher-Frankild S, Jensen L J, Mann M. Mass spectrometry of human leukocyte antigen class I peptidomes reveals strong effects of protein abundance and turnover on antigen presentation. Mol Cell Proteomics. 2015 March; 14(3):658-73. doi: 10.1074/mcp.M114.042812.
58. Abelin J G, Trantham P D, Penny S A, Patterson A M, Ward S T, Hildebrand W H, Cobbold M, Bai D L, Shabanowitz J, Hunt D F. Complementary IMAC enrichment methods for HLA-associated phosphopeptide identification by mass spectrometry. Nat Protoc. 2015 September; 10(9):1308-18. doi: 10.1038/nprot.2015.086. Epub 2015 Aug. 6
59. Barnstable C J, Bodmer W F, Brown G, Galfre G, Milstein C, Williams A F, Ziegler A. Production of monoclonal antibodies to group A erythrocytes, HLA and other human cell surface antigens-new tools for genetic analysis. Cell. 1978 May; 14(1):9-20.
60. Goldman J M, Hibbin J, Kearney L, Orchard K, Th'ng K H. HLA-DR monoclonal antibodies inhibit the proliferation of normal and chronic granulocytic leukaemia myeloid progenitor cells. Br J Haematol. 1982 November; 52(3):411-20.
61. Eng J K, Jahan T A, Hoopmann M R. Comet: an open-source MS/MS sequence database search tool. Proteomics. 2013 January; 13(1):22-4. doi: 10.1002/pmic.201200439. Epub 2012 Dec. 4.
62. Eng J K, Hoopmann M R, Jahan T A, Egertson J D, Noble W S, MacCoss M J. A deeper look into Comet—implementation and features. J Am Soc Mass Spectrom. 2015 November; 26(11):1865-74. doi: 10.1007/s13361-015-1179-x. Epub 2015 Jun. 27.
63. Lukas Kall, Jesse Canterbury, Jason Weston, William Stafford Noble and Michael J. MacCoss. Semi-supervised learning for peptide identification from shotgun proteomics datasets. Nature Methods 4:923-925, November 2007
64. Lukas Kall, John D. Storey, Michael J. MacCoss and William Stafford Noble. Assigning confidence measures to peptides identified by tandem mass spectrometry. Journal of Proteome Research, 7(1):29-34, January 2008
65. Lukas Kall, John D. Storey and William Stafford Noble. Nonparametric estimation of posterior error probabilities associated with peptides identified by tandem mass spectrometry. Bioinformatics, 24(16):i42-i48, August 2008
66. Kinney R M, B J Johnson, V L Brown, D W Trent. Nucleotide Sequence of the 26 S mRNA of the Virulent Trinidad Donkey Strain of Venezuelan Equine Encephalitis Virus and Deduced Sequence of the Encoded Structural Proteins. Virology 152 (2), 400-413. 1986 Jul. 30.
67. Jill E Slansky, Frédérique M Rattis, Lisa F Boyd, Tarek Fahmy, Elizabeth M Jaffee, Jonathan P Schneck, David H Margulies, Drew M Pardoll. Enhanced Antigen-Specific Antitumor Immunity with Altered Peptide Ligands that Stabilize the MHC-Peptide-TCR Complex. Immunity, Volume 13, Issue 4, 1 Oct. 2000, Pages 529-538.
68. A Y Huang, P H Gulden, A S Woods, M C Thomas, C D Tong, W Wang, V H Engelhard, G Pasternack, R Cotter, D Hunt, D M Pardoll, and E M Jaffee. The immunodominant major histocompatibility complex class I-restricted antigen of a murine colon tumor derives from an endogenous retroviral gene product. Proc Natl Acad Sci USA.; 93(18): 9730-9735, 1996 Sep. 3.
69. JOHNSON, BARBARA J. B., RICHARD M. KINNEY, CRYSTLE L. KOST AND DENNIS W. TRENT. Molecular Determinants of Alphavirus Neurovirulence: Nucleotide and Deduced Protein Sequence Changes during Attenuation of Venezuelan Equine Encephalitis Virus. J Gen Virol 67:1951-1960, 1986.
70. Aarnoudse, C. A., Kruse, M., Konopitzky, R., Brouwenstijn, N., and Schrier, P. I. (2002). TCR reconstitution in Jurkat reporter cells facilitates the identification of novel tumor antigens by cDNA expression cloning. Int J Cancer 99, 7-13.
71. Alexander, J., Sidney, J., Southwood, S., Ruppert, J., Oseroff, C., Maewal, A., Snoke, K., Serra, H.M., Kubo, R. T., and Sette, A. (1994). Development of high potency universal DR-restricted helper epitopes by modification of high affinity DR-blocking peptides. Immunity 1, 751-761.
72. Banu, N., Chia, A., Ho, Z. Z., Garcia, A. T., Paravasivam, K., Grotenbreg, G. M., Bertoletti, A., and Gehring, A. J. (2014). Building and optimizing a virus-specific T cell receptor library for targeted immunotherapy in viral infections. Scientific Reports 4, 4166.
73. Cornet, S., Miconnet, I., Menez, J., Lemonnier, F., and Kosmatopoulos, K. (2006). Optimal organization of a polypeptide-based candidate cancer vaccine composed of cryptic tumor peptides with enhanced immunogenicity. Vaccine 24, 2102-2109.
74. Depla, E., van der Aa, A., Livingston, B. D., Crimi, C., Allosery, K., de Brabandere, V., Krakover, J., Murthy, S., Huang, M., Power, S., et al. (2008). Rational design of a multiepitope vaccine encoding T-lymphocyte epitopes for treatment of chronic hepatitis B virus infections. Journal of Virology 82, 435-450.
75. Ishioka, G. Y., Fikes, J., Hermanson, G., Livingston, B., Crimi, C., Qin, M., del Guercio, M. F., Oseroff, C., Dahlberg, C., Alexander, J., et al. (1999). Utilization of MHC class I transgenic mice for development of minigene DNA vaccines encoding multiple HLA-restricted CTL epitopes. J Immunol 162, 3915-3925.
76. Janetzki, S., Price, L., Schroeder, H., Britten, C. M., Welters, M. J. P., and Hoos, A. (2015). Guidelines for the automated evaluation of Elispot assays. Nat Protoc 10, 1098-1115.
77. Lyons, G. E., Moore, T., Brasic, N., Li, M., Roszkowski, J. J., and Nishimura, M. I. (2006). Influence of human CD8 on antigen recognition by T-cell receptor-transduced cells. Cancer Res 66, 11455-11461.
78. Nagai, K., Ochi, T., Fujiwara, H., An, J., Shirakata, T., Mineno, J., Kuzushima, K., Shiku, H., Melenhorst, J. J., Gostick, E., et al. (2012). Aurora kinase A-specific T-cell receptor gene transfer redirects T lymphocytes to display effective antileukemia reactivity. Blood 119, 368-376.
79. Panina-Bordignon, P., Tan, A., Termijtelen, A., Demotz, S., Corradin, G., and Lanzavecchia, A. (1989). Universally immunogenic T cell epitopes: promiscuous binding to human MHC class II and promiscuous recognition by T cells. Eur J Immunol 19, 2237-2242.
80. Vitiello, A., Marchesini, D., Furze, J., Sherman, L. A., and Chesnut, R. W. (1991). Analysis of the HLA-restricted influenza-specific cytotoxic T lymphocyte response in transgenic mice carrying a chimeric human-mouse class I major histocompatibility complex. J Exp Med 173, 1007-1015.
81. Yachi, P. P., Ampudia, J., Zal, T., and Gascoigne, N. R. J. (2006). Altered peptide ligands induce delayed CD8-T cell receptor interaction—a role for CD8 in distinguishing antigen quality. Immunity 25, 203-211.
82. Pushko P, Parker M, Ludwig G V, Davis N L, Johnston R E, Smith J F. Replicon-helper systems from attenuated Venezuelan equine encephalitis virus: expression of heterologous genes in vitro and immunization against heterologous pathogens in vivo. Virology. 1997 Dec. 22; 239(2):389-401.
83. Strauss, J H and E G Strauss. The alphaviruses: gene expression, replication, and evolution. Microbiol Rev. 1994 September; 58(3): 491-562.
84. Rhême C, Ehrengruber M U, Grandgirard D. Alphaviral cytotoxicity and its implication in vector development. Exp Physiol. 2005 January; 90(1):45-52. Epub 2004 Nov. 12.
85. Riley, Michael K. II, and Wilfred Vermerris. Recent Advances in Nanomaterials for Gene Delivery—A Review. Nanomaterials 2017, 7(5), 94.
86. Frolov I, Hardy R, Rice C M. Cis-acting RNA elements at the 5' end of Sindbis virus genome RNA regulate minus- and plus-strand RNA synthesis. RNA. 2001 November; 7(11):1638-51.
87. Jose J, Snyder J E, Kuhn R J. A structural and functional perspective of alphavirus replication and assembly. Future Microbiol. 2009 September; 4(7):837-56.
88. Bo Li and C. olin N. Dewey. RSEM: accurate transcript quantification from RNA-Seq data with or without a referenfe genome. BMC Bioinformatics, 12:323, August 2011
89. Hillary Pearson, Tariq Daouda, Diana Paola Granados, Chantal Durette, Eric Bonneil, Mathieu Courcelles, Anja Rodenbrock, Jean-Philippe Laverdure, Caroline Côté, Sylvie Mader, Sébastien Lemieux, Pierre Thibault, and Claude Perreault. MHC class I-associated peptides derive from selective regions of the human genome. The Journal of Clinical Investigation, 2016,
90. Juliane Liepe, Fabio Marino, John Sidney, Anita Jeko, Daniel E. Bunting, Alessandro Sette, Peter M. Kloetzel, Michael P. H. Stumpf, Albert J. R. Heck, Michele Mishto. A large fraction of HLA class I ligands are proteasome-generated spliced peptides. Science, 21, October 2016.
91. Mommen G P., Marino, F., Meiring H D., Poelen, M C., van Gaans-van den Brink, J A., Mohammed S., Heck A J., and van Els C A. Sampling From the Proteome to the Human Leukocyte Antigen-DR (HLA-DR) Ligandome Proceeds Via High Specificity. *Mol Cell* Proteomics 15(4): 1412-1423, April 2016.
92. Sebastian Kreiter, Mathias Vormehr, Niels van de Roemer, Mustafa Diken, Martin Löwer, Jan Diekmann, Sebastian Boegel, Barbara Schrörs, Fulvia Vascotto, John C. Castle, Arbel D. Tadmor, Stephen P. Schoenberger, Christoph Huber, Özlem Türeci, and Ugur Sahin. Mutant MHC class II epitopes drive therapeutic immune responses to caner. Nature 520, 692-696, April 2015.
93. Tran E., Turcotte S., Gros A., Robbins P. F., Lu Y. C., Dudley M. E., Wunderlich J. R., Somerville R. P., Hogan K., Hinrichs C. S., Parkhurst M. R., Yang J. C., Rosenberg S. A. Cancer immunotherapy based on mutation-specific CD4+ T cells in a patient with epithelial cancer. Science 344(6184) 641-645, May 2014.
94. Andreatta M., Karosiene E., Rasmussen M., Stryhn A., Buus S., Nielsen M. Accurate pan-specific prediction of peptide-MHC class II binding affinity with improved binding core identification. Immunogenetics 67(11-12) 641-650, November 2015.
95. Nielsen, M., Lund, O. NN-align. An artificial neural network-based alignment algorithm for MHC class II peptide binding prediction. BMC Bioinformatics 10:296, September 2009.
96. Nielsen, M., Lundegaard, C., Lund, O. Prediction of MHC class II binding affinity using SMM-align, a novel stabilization matrix alignment method. BMC Bioinformatics 8:238, July 2007.
97. Zhang, J., et al. PEAKS DB: de novo sequencing assisted database search for sensitive and accurate peptide identification. Molecular & Cellular Proteomics. 11(4):1-8. Jan. 2, 2012.
98. Jensen, Kamilla Kjaergaard, et al. "Improved Methods for Prediting Peptide Binding Affinity to MHC Class II Molecules." Immunology, 2018, doi:10.1111/imm.12889.
99. Carter, S. L., Cibulskis, K., Helman, E., McKenna, A., Shen, H., Zack, T., Laird, P. W., Onofrio, R. C., Winckler, W., Weir, B. A., et al. (2012). Absolute quantification of somatic DNA alterations in human cancer. Nat. Biotechnol. 30, 413-421
100. McGranahan, N., Rosenthal, R., Hiley, C. T., Rowan, A. J., Watkins, T. B. K., Wilson, G. A., Birkbak, N. J., Veeriah, S., Van Loo, P., Herrero, J., et al. (2017). Allele-Specific HLA Loss and Immune Escape in Lung Cancer Evolution. Cell 171, 1259-1271.e11.
101. Shukla, S. A., Rooney, M. S., Rajasagi, M., Tiao, G., Dixon, P. M., Lawrence, M. S., Stevens, J., Lane, W. J., Dellagatta, J. L., Steelman, S., et al. (2015). Comprehensive analysis of cancer-associated somatic mutations in class I HLA genes. Nat. Biotechnol. 33, 1152-1158.
102. Van Loo, P., Nordgard, S. H., Lingjærde, O. C., Russnes, H. G., Rye, I. H., Sun, W., Weigman, V. J., Marynen, P., Zetterberg, A., Naume, B., et al. (2010). Allele-specific copy number analysis of tumors. Proc. Natl. Acad. Sci. U.S.A. 107, 16910-16915.
103. Van Loo, P., Nordgard, S. H., Lingjærde, O. C., Russnes, H. G., Rye, I. H., Sun, W., Weigman, V. J., Marynen, P., Zetterberg, A., Naume, B., et al. (2010). Allele-specific copy number analysis of tumors. Proc. Natl. Acad. Sci. U.S.A. 107, 16910-16915.

SEQUENCE LISTING (210 sequences)

SEQ ID NO: 1 - DNA, 36519 bp, synthetic construct
  misc_feature 1..36519: note = Description of Artificial Sequence: Synthetic polynucleotide
  source 1..36519: mol_type = other DNA
ccatcwtcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagatgaggcacctgagagacctgcccgatgagaaaatcatcatcgcttccgggaacgagattctggaactggtggtaaatgccatgatgggcgacgaccctccggagccccccaccccatttgagacaccttcgctgcacgatttgtatgatctggaggtggatgtgcccgaggacgatcccaatgaggaggcggtaaatgatttttttagcgatgccgcgctgctagctgccgaggaggcttcgagctctagctcagacagcgactcttcactgcatacccctagacccggcagaggtgagaaaaagatccccgagcttaaaggggaagagatggacttgcgctgctatgaggaatgcttgcccccgagcgatgatgaggacgagcaggcgatccagaacgcagcgagccagggagtgcaagccgccagcgagagctttgcgctggactgcccgcctctgcccggacacggctgtaagtcttgtgaatttcatcgcatgaatactggagataaagctgtgttgtgtgcactttgctatatgagagcttacaaccattgtgtttacagtaagtgtgattaagttgaactttagagggaggcagagagcagggtgactgggcgatgactggtttatttatgtatatatgttctttatataggtcccgtctctgacgcagatgatgagacccccactacaaagtccacttcgtcacccccagaaattggcacatctccacctgagaatattgttagaccagttcctgttagagccactgggaggagagcagctgtggaatgtttggatgacttgctacagggtggggttgaacctttggacttgtgtacccggaaacgccccaggcactaagtgccacacatgtgtgtttacttgaggtgatgtcagtatttatagggtgtggagtgcaataaaaaatgtgttgactttaagtgcgtggtttatgactcaggggtggggactgtgagtatataagcaggtgcagacctgtgtggttagctcagagcggcatggagatttggacggtcttggaagactttcacaagactagacagctgctagagaacgcctcgaacggagtctcttacctgtggagattctgcttcggtggcgacctagctaggctagtctacagggccaaacaggattatagtgaacaatttgaggttattttgagagagtgttctggtctttttgacgctcttaacttgggccatcagtctcactttaaccagaggatttcgagagcccttgattttactactcctggcagaaccactgcagcagtagccttttttgcttttattcttgacaaatggagtcaagaaacccatttcagcagggattaccagctggatttcttagcagtagctttgtggagaacatggaagtgccagcgcctgaatgcaatctccggctacttgccggtacagccgctagacactctgaggatcctgaatctccaggagagtcccagggcacgccaacgtcgccagcagcagcagcaggaggaggatcaagaagagaacccgagagccggcctggaccctccggcggaggaggaggagtagctgacctgtttcctgaactgcgccgggtgctgactaggtcttcgagtggtcgggagagggggattaagcgggagaggcatgatgagactaatcacagaactgaactgactgtgggtctgatgagtcgcaagcgcccagaaacagtgtggtggcatgaggtgcagtcgactggcacagatgaggtgtcggtgatgcatgagaggttttctctagaacaagtcaagacttgttggttagagcctgaggatgattgggaggtagccatcaggaattatgccaagctggctctgaggccagacaagaagtacaagattactaagctgataaatatcagaaatgcctgctacatctcagggaatggggctgaagtggagatctgtctccaggaaagggtggctttcagatgctgcatgatgaatatgtacccgggagtggtgggcatggatggggttacctttatgaacatgaggttcaggggagatgggtataatggcacggtctttatggccaataccaagctgacagtccatggctgctccttctttgggtttaataacacctgcatcgaggcctggggtcaggtcggtgtgaggggctgcagtttttcagccaactggatgggggtcgtgggcaggaccaagagtatgctgtccgtgaagaaatgcttgtttgagaggtgccacctgggggtgatgagcgagggcgaagccagaatccgccactgcgcctctaccgagacgggctgctttgtgctgtgcaagggcaatgctaagatcaagcataatatgatctgtggagcctcggacgagcgcggctaccagatgctgacctgcgccggcgggaacagccatatgctggccaccgtacatgtggcttcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggatgtgacggaggacctgcgacccgatcatttggtgttgccctgcaccgggacggagttcggttccagcggggaagaatctgactagagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgtccgatcctggtcgagcgcgagcaaggacagacccttctgactctgtactgcatctgcaaccaccccggcctgcatgaaagtctttgttgtctgctgtgtactgagtataataaaagctgagatcagcgactactccggacttccgtgtgttcctgaatccatcaaccagtctttgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactaacctccaccaacgccaccgtcgcgacctttctgaatctaatactaccacccacaccggaggtgagctccgaggtcaaccaacctctgggatttactacggcccctgggaggtggttgggttaatagcgctaggcctagttgcgggtgggcttttggttctctgctacctatacctcccttgctgttcgtacttagtggtgctgtgttgctggtttaagaaatggggaagatcaccctagtgagctgcggtgcgctggtggcggtgttgctttcgattgtgggactgggcggtgcggctgtagtgaaggagaaggccgatccctgcttgcatttcaatcccaacaaatgccagctgagttttcagcccgatggcaatcggtgcgcggtactgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcgcacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgaaaaagaaaaacagccataacgttttttttcacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcatttcggacatggaattttatcaagtttctgtgtctgaacccaccacgcctagaatgaccacaaccacaaaaactacacctgttaccactatgcagctcactaccaataacatttttgccatgcgtcaaatggtcaacaatagcactcaacccaccccacccagtgaggaaattcccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttaattttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatatcacgaaatcatatgctggcagttacacctgccctggagatgatgctgacagtatgattttttacaaagtaactgttgttgatcccactactccacctccacccaccacaactactcacaccacacacacagatcaaaccgcagcagaggaggcagcaaagttagccttgcaggtccaagacagttcatttgttggcattacccctacacctgatcagcggtgtccggggctgctagtcagcggcattgtcggtgtgctttcgggattagcagtcataatcatctgcatgttcatttttgcttgctgctatagaaggctttaccgacaaaaatcagacccactgctgaacctctatgtttaattttttccagagtcatgaaggcagttagcgctctagttttttgttctttgattggcattgttttttgcaatcctattcctaaagttagctttattaaagatgtgaatgttactgaggggggcaatgtgacactggtaggtgtagagggtgctgaaaacaccacctggacaaaataccacctcaatgggtggaaagatatttgcaattggagtgtattagtttatacatgtgagggagttaatcttaccattgtcaatgccacctcagctcaaaatggtagaattcaaggacaaagtgtcagtgtatctaatgggtattttacccaacatacttttatctatgacgttaaagtcataccactgcctacgcctagcccacctagcactaccacacagacaacccacactacacagacaaccacatacagtacattaaatcagcctaccaccactacagcagcagaggttgccagctcgtctggggtccgagtggcatttttgatgtgggccccatctagcagtcccactgctagtaccaatgagcagactactgaatttttgtccactgtcgagagccacaccacagctacctccagtgccttctctagcaccgccaatctctcctcgctttcctctacaccaatcagtcccgctactactcctagccccgctcctcttcccactcccctgaagcaaacagacggcggcatgcaatggcagatcaccctgctcattgtgatcgggttggtcatcctggccgtgttgctctactacatcttctgccgccgcattcccaacgcgcaccgcaagccggtctacaagcccatcattgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcaccacctgcatctgctgctgtagcatagtctgcctgcttatcaccttcttccagttcattgactggatctttgtgcgcatcgcctacctgcgccaccacccccagtaccgcgaccagcgagtggcgcggctgctcaggctcctctgataagcatgcgggctctgctacttctcgcgcttctgctgttagtgctcccccgtcccgtcgacccccggtcccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccactacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggatgcggtggccatccaccagtgcaagagaggcatcttctgcctggtgaaacaggccaagatctcctacgaggtcactccaaacgaccatcgcctctcctacgagctcctgcagcagcgccagaagttcacctgcctggtcggagtcaaccccatcgtcatcacccagcagtctggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 2 - DNA, 31604 bp, synthetic construct
  misc_feature 1..31604: note = Description of Artificial Sequence: Synthetic polynucleotide
  source 1..31604: mol_type = other DNA
ccatcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggaacgccatccacgctgttttgacctccatagaagacagcgatcgcgccaccatggccgggatgttccaggcactgtccgaaggctgcacaccctatgatattaaccagatgctgaatgtcctgggagaccaccaggtctctggcctggagcagctggagagcatcatcaacttcgagaagctgaccgagtggacaagctccaatgtgatgcctatcctgtccccactgaccaagggcatcctgggcttcgtgtttaccctgacagtgccttctgagcggggcctgtcttgcatcagcgaggcagacgcaaccacaccagagtccgccaatctgggcgaggagatcctgtctcagctgtacctgtggccccgggtgacatatcactccccttcttacgcctatcaccagttcgagcggagagccaagtacaagagacacttcccaggctttggccagtctctgctgttcggctaccccgtgtacgtgttcggcgattgcgtgcagggcgactgggatgccatccggtttagatactgcgcaccacctggatatgcactgctgaggtgtaacgacaccaattattccgccctgctggcagtgggcgccctggagggccctcgcaatcaggattggctgggcgtgccaaggcagctggtgacacgcatgcaggccatccagaacgcaggcctgtgcaccctggtggcaatgctggaggagacaatcttctggctgcaggcctttctgatggccctgaccgacagcggccccaagacaaacatcatcgtggattcccagtacgtgatgggcatctccaagccttctttccaggagtttgtggactgggagaacgtgagcccagagctgaattccaccgatcagccattctggcaggcaggaatcctggcaaggaacctggtgcctatggtggccacagtgcagggccagaatctgaagtaccagggccagagcctggtcatcagcgcctccatcatcgtgtttaacctgctggagctggagggcgactatcgggacgatggcaacgtgtgggtgcacaccccactgagccccagaacactgaacgcctgggtgaaggccgtggaggagaagaagggcatcccagtgcacctggagctggcctccatgaccaatatggagctgatgtctagcatcgtgcaccagcaggtgaggacatacggacccgtgttcatgtgcctgggaggcctgctgaccatggtggcaggagccgtgtggctgacagtgcgggtgctggagctgttcagagccgcccagctggccaacgatgtggtgctgcagatcatggagctgtgcggagcagcctttcgccaggtgtgccacaccacagtgccatggcccaatgcctccctgacccccaagtggaacaatgagacaacacagcctcagatcgccaactgtagcgtgtacgacttcttcgtgtggctgcactactatagcgtgagggataccctgtggccccgcgtgacataccacatgaataagtacgcctatcacatgctggagaggcgcgccaagtataagagaggccctggcccaggcgcaaagtttgtggcagcatggaccctgaaggccgccgccggccccggccccggccagtatatcaaggctaacagtaagttcattggaatcacagagctgggacccggacctggataatgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 3 - DNA, 11447 bp, Venezuelan equine encephalitis virus
  source 1..11447: mol_type = other DNA
atgggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgctggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgacatagtctagtccgccaagatgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaagaaaccgaagaaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaaggagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactccatacatctcgcccgtgtcacattgtggatgggcacggttatttcctgcttgccaggtgcccggcaggggactccatcaccatggaatttaagaaagattccgtcacacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgttgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataacctttggtttcagatcagtgtcactgaaactgcaccctaagaatcccacatatctaaccacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaattaactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctcagatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttattttttcttttcttttccgaatcggattttgtttttaatatttc

SEQ ID NO: 4 - DNA, 9577 bp, synthetic construct
  misc_feature 1..9577: note = Description of Artificial Sequence: Synthetic polynucleotide
  source 1..9577: mol_type = other DNA
atgggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgctggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgactctagaatagtctttaattaagccaccatggcaggcatgtttcaggcgctgagcgaaggctgcaccccgtatgatattaaccagatgctgaacgtgctgggcgatcatcaggtctcaggccttgagcagcttgagagtataatcaactttgaaaaactgactgaatggaccagttctaatgttatgcctatcctgtctcctctgacaaagggcatcctgggcttcgtgtttaccctgaccgtgccttctgagagaggacttagctgcattagcgaagcggatgcgaccaccccggaaagcgcgaacctgggcgaagaaattctgagccagctgtatctttggccaagggtgacctaccattcccctagttatgcttaccaccaatttgaaagacgagccaaatataaaagacacttccccggctttggccagagcctgctgtttggctaccctgtgtacgtgttcggcgattgcgtgcagggcgattgggatgcgattcgctttcgctattgcgcgccgccgggctatgcgctgctgcgctgcaacgataccaactatagcgctctgctggctgtgggggccctagaaggacccaggaatcaggactggcttggtgtcccaagacaacttgtaactcggatgcaggctattcagaatgccggcctgtgtaccctggtggccatgctggaagagacaatcttctggctgcaagcgtttctgatggcgctgaccgatagcggcccgaaaaccaacattattgtggatagccagtatgtgatgggcattagcaaaccgagctttcaggaatttgtggattgggaaaacgtgagcccggaactgaacagcaccgatcagccgttttggcaagccggaatcctggccagaaatctggtgcctatggtggccacagtgcagggccagaacctgaagtaccagggtcagtcactagtcatctctgcttctatcattgtcttcaacctgctggaactggaaggtgattatcgagatgatggcaacgtgtgggtgcataccccgctgagcccgcgcaccctgaacgcgtgggtgaaagcggtggaagaaaaaaaaggtattccagttcacctagagctggccagtatgaccaacatggagctcatgagcagtattgtgcatcagcaggtcagaacatacggccccgtgttcatgtgtctcggcggactgcttacaatggtggctggtgctgtgtggctgacagtgcgagtgctcgagctgttccgggccgcgcagctggccaacgacgtggtcctccagatcatggagctttgtggtgcagcgtttcgccaggtgtgccataccaccgtgccgtggccgaacgcgagcctgaccccgaaatggaacaacgaaaccacccagccccagatcgccaactgcagcgtgtatgacttttttgtgtggctccattattattctgttcgagacacactttggccaagggtgacctaccatatgaacaaatatgcgtatcatatgctggaaagacgagccaaatataaaagaggaccaggacctggcgctaaatttgtggccgcctggacactgaaagccgctgctggtcctggacctggccagtacatcaaggccaacagcaagttcatcggcatcaccgaactcggacccggaccaggctgatgattcgaacggccgtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttattttttcttttcttttccgaatcggattttgtttttaatatttcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5 - DNA, 11447 bp, Venezuelan equine encephalitis virus; identical to SEQ ID NO: 3
  source 1..11447: mol_type = other DNA

SEQ ID NO: 6 - DNA, 7894 bp, synthetic construct
  misc_feature 1..7894: note = Description of Artificial Sequence: Synthetic polynucleotide
  source 1..7894: mol_type = other DNA
atgggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgctggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgactatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttattttttcttttcttttccgaatcggattttgtttttaatatttcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 7 - DNA, 7893 bp, synthetic construct
  misc_feature 1..7893: note = Description of Artificial Sequence: Synthetic polynucleotide
  source 1..7893: mol_type = other DNA
ataggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgactatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttatttttcttttcttttccgaatcggattttgtttttaatatttcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8 - DNA, 7927 bp, synthetic construct
  misc_feature 1..7927: note = Description of Artificial Sequence: Synthetic polynucleotide
  source 1..7927: mol_type = other DNA
taatacgactcactataggatgggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgctggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgactatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttattttttcttttcttttccgaatcggattttgtttttaatatttcaaaaaaaaaaaaaaaaaaaaaaaaaaaaaaaaaaaaaaaaaaaaaaaaaaaaaaaaaaaaaaaaaaaaaaaaaaaaaaaatacgtagtttaaac

SEQ ID NO: 9 - DNA, 7926 bp, synthetic construct
  misc_feature 1..7926: note = Description of Artificial Sequence: Synthetic polynucleotide
  source 1..7926: mol_type = other DNA
taatacgactcactataggataggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgactatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttatttttcttttcttttccgaatcggattttgtttttaatatttcaaaaaaaaaaaaaaaaaaaaaaaaaaaaaaaaaaaaaaaaaaaaaaaaaaaaaaaaaaaaaaaaaaaaaaaaaaaaaaaatacgtagtttaaac

SEQ ID NO: 10 - DNA, 36519 bp, synthetic construct
  misc_feature 1..36519: note = Description of Artificial Sequence: Synthetic polynucleotide
  source 1..36519: mol_type = other DNA
ccatcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagatgaggcacctgagagacctgcccgatgagaaaatcatcatcgcttccgggaacgagattctggaactggtggtaaatgccatgatgggcgacgaccctccggagccccccaccccatttgagacaccttcgctgcacgatttgtatgatctggaggtggatgtgcccgaggacgatcccaatgaggaggcggtaaatgatttttttagcgatgccgcgctgctagctgccgaggaggcttcgagctctagctcagacagcgactcttcactgcatacccctagacccggcagaggtgagaaaaagatccccgagcttaaaggggaagagatggacttgcgctgctatgaggaatgcttgcccccgagcgatgatgaggacgagcaggcgatccagaacgcagcgagccagggagtgcaagccgccagcgagagctttgcgctggactgcccgcctctgcccggacacggctgtaagtcttgtgaatttcatcgcatgaatactggagataaagctgtgttgtgtgcactttgctatatgagagcttacaaccattgtgtttacagtaagtgtgattaagttgaactttagagggaggcagagagcagggtgactgggcgatgactggtttatttatgtatatatgttctttatataggtcccgtctctgacgcagatgatgagacccccactacaaagtccacttcgtcacccccagaaattggcacatctccacctgagaatattgttagaccagttcctgttagagccactgggaggagagcagctgtggaatgtttggatgacttgctacagggtggggttgaacctttggacttgtgtacccggaaacgccccaggcactaagtgccacacatgtgtgtttacttgaggtgatgtcagtatttatagggtgtggagtgcaataaaaaatgtgttgactttaagtgcgtggtttatgactcaggggtggggactgtgagtatataagcaggtgcagacctgtgtggttagctcagagcggcatggagatttggacggtcttggaagactttcacaagactagacagctgctagagaacgcctcgaacggagtctcttacctgtggagattctgcttcggtggcgacctagctaggctagtctacagggccaaacaggattatagtgaacaatttgaggttattttgagagagtgttctggtctttttgacgctcttaacttgggccatcagtctcactttaaccagaggatttcgagagcccttgattttactactcctggcagaaccactgcagcagtagccttttttgcttttattcttgacaaatggagtcaagaaacccatttcagcagggattaccagctggatttcttagcagtagctttgtggagaacatggaagtgccagcgcctgaatgcaatctccggctacttgccggtacagccgctagacactctgaggatcctgaatctccaggagagtcccagggcacgccaacgtcgccagcagcagcagcaggaggaggatcaagaagagaacccgagagccggcctggaccctccggcggaggaggaggagtagctgacctgtttcctgaactgcgccgggtgctgactaggtcttcgagtggtcgggagagggggattaagcgggagaggcatgatgagactaatcacagaactgaactgactgtgggtctgatgagtcgcaagcgcccagaaacagtgtggtggcatgaggtgcagtcgactggcacagatgaggtgtcggtgatgcatgagaggttttctctagaacaagtcaagacttgttggttagagcctgaggatgattgggaggtagccatcaggaattatgccaagctggctctgaggccagacaagaagtacaagattactaagctgataaatatcagaaatgcctgctacatctcagggaatggggctgaagtggagatctgtctccaggaaagggtggctttcagatgctgcatgatgaatatgtacccgggagtggtgggcatggatggggttacctttatgaacatgaggttcaggggagatgggtataatggcacggtctttatggccaataccaagctgacagtccatggctgctccttctttgggtttaataacacctgcatcgaggcctggggtcaggtcggtgtgaggggctgcagtttttcagccaactggatgggggtcgtgggcaggaccaagagtatgctgtccgtgaagaaatgcttgtttgagaggtgccacctgggggtgatgagcgagggcgaagccagaatccgccactgcgcctctaccgagacgggctgctttgtgctgtgcaagggcaatgctaagatcaagcataatatgatctgtggagcctcggacgagcgcggctaccagatgctgacctgcgccggcgggaacagccatatgctggccaccgtacatgtggcttcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggatgtgacggaggacctgcgacccgatcatttggtgttgccctgcaccgggacggagttcggttccagcggggaagaatctgactagagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgtccgatcctggtcgagcgcgagcaaggacagacccttctgactctgtactgcatctgcaaccaccccggcctgcatgaaagtctttgttgtctgctgtgtactgagtataataaaagctgagatcagcgactactccggacttccgtgtgttcctgaatccatcaaccagtctttgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactaacctccaccaacgccaccgtcgcgacctttctgaatctaatactaccacccacaccggaggtgagctccgaggtcaaccaacctctgggatttactacggcccctgggaggtggttgggttaatagcgctaggcctagttgcgggtgggcttttggttctctgctacctatacctcccttgctgttcgtacttagtggtgctgtgttgctggtttaagaaatggggaagatcaccctagtgagctgcggtgcgctggtggcggtgttgctttcgattgtgggactgggcggtgcggctgtagtgaaggagaaggccgatccctgcttgcatttcaatcccaacaaatgccagctgagttttcagcccgatggcaatcggtgcgcggtactgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcgcacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgaaaaagaaaaacagccataacgttttttttcacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcatttcggacatggaattttatcaagtttctgtgtctgaacccaccacgcctagaatgaccacaaccacaaaaactacacctgttaccactatgcagctcactaccaataacatttttgccatgcgtcaaatggtcaacaatagcactcaacccaccccacccagtgaggaaattcccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttaattttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatatcacgaaatcatatgctggcagttacacctgccctggagatgatgctgacagtatgattttttacaaagtaactgttgttgatcccactactccacctccacccaccacaactactcacaccacacacacagatcaaaccgcagcagaggaggcagcaaagttagccttgcaggtccaagacagttcatttgttggcattacccctacacctgatcagcggtgtccggggctgctagtcagcggcattgtcggtgtgctttcgggattagcagtcataatcatctgcatgttcatttttgcttgctgctatagaaggctttaccgacaaaaatcagacccactgctgaacctctatgtttaattttttccagagtcatgaaggcagttagcgctctagttttttgttctttgattggcattgttttttgcaatcctattcctaaagttagctttattaaagatgtgaatgttactgaggggggcaatgtgacactggtaggtgtagagggtgctgaaaacaccacctggacaaaataccacctcaatgggtggaaagatatttgcaattggagtgtattagtttatacatgtgagggagttaatcttaccattgtcaatgccacctcagctcaaaatggtagaattcaaggacaaagtgtcagtgtatctaatgggtattttacccaacatacttttatctatgacgttaaagtcataccactgcctacgcctagcccacctagcactaccacacagacaacccacactacacagacaaccacatacagtacattaaatcagcctaccaccactacagcagcagaggttgccagctcgtctggggtccgagtggcatttttgatgttggccccatctagcagtcccactgctagtaccaatgagcagactactgaatttttgtccactgtcgagagccacaccacagctacctccagtgccttctctagcaccgccaatctctcctcgctttcctctacaccaatcagtcccgctactactcctagccccgctcctcttcccactcccctgaagcaaacagacggcggcatgcaatggcagatcaccctgctcattgtgatcgggttggtcatcctggccgtgttgctctactacatcttctgccgccgcattcccaacgcgcaccgcaagccggtctacaagcccatcattgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcaccacctgcatctgctgctgtagcatagtctgcctgcttatcaccttcttccagttcattgactggatctttgtgcgcatcgcctacctgcgccaccacccccagtaccgcgaccagcgagtggcgcggctgctcaggctcctctgataagcatgcgggctctgctacttctcgcgcttctgctgttagtgctcccccgtcccgtcgacccccggtcccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccactacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggatgcggtggccatccaccagtgcaagagaggcatcttctgcctggtgaaacaggccaagatctcctacgaggtcactccaaacgaccatcgcctctcctacgagctcctgcagcagcgccagaagttcacctgcctggtcggagtcaaccccatcgtcatcacccagcagtctggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 11 - DNA, 31867 bp, synthetic construct
  misc_feature 1..31867: note = Description of Artificial Sequence: Synthetic polynucleotide
  source 1..31867: mol_type = other DNA
ccatcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggaacgccatccacgctgttttgacctccatagaagacagcgatcgcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctttacaagtagtgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgctctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgtccgatcctggtcgagcgcgagcaaggacagacccttctgactctgtactgcatctgcaaccaccccggcctgcatgaaagtctttgttgtctgctgtgtactgagtataataaaagctgagatcagcgactactccggacttccgtgtgttcctgaatccatcaaccagtctttgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactaacctccaccaacgccaccgtcgcgacggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggatgcggtggccatccaccagtgcaagagaggcatcttctgcctggtgaaacaggccaagatctcctacgaggtcactccaaacgaccatcgcctctcctacgagctcctgcagcagcgccagaagttcacctgcctggtcggagtcaaccccatcgtcatcacccagcagtctggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcgtgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 12 - DNA, 32788 bp, synthetic construct
  misc_feature 1..32788: note = Description of Artificial Sequence: Synthetic polynucleotide
  source 1..32788: mol_type = other DNA
ccatcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggaacgccatccacgctgttttgacctccatagaagacagcgatcgcgccaccatggccgggatgttccaggcactgtccgaaggctgcacaccctatgatattaaccagatgctgaatgtcctgggagaccaccaggtctctggcctggagcagctggagagcatcatcaacttcgagaagctgaccgagtggacaagctccaatgtgatgcctatcctgtccccactgaccaagggcatcctgggcttcgtgtttaccctgacagtgccttctgagcggggcctgtcttgcatcagcgaggcagacgcaaccacaccagagtccgccaatctgggcgaggagatcctgtctcagctgtacctgtggccccgggtgacatatcactccccttcttacgcctatcaccagttcgagcggagagccaagtacaagagacacttcccaggctttggccagtctctgctgttcggctaccccgtgtacgtgttcggcgattgcgtgcagggcgactgggatgccatccggtttagatactgcgcaccacctggatatgcactgctgaggtgtaacgacaccaattattccgccctgctggcagtgggcgccctggagggccctcgcaatcaggattggctgggcgtgccaaggcagctggtgacacgcatgcaggccatccagaacgcaggcctgtgcaccctggtggcaatgctggaggagacaatcttctggctgcaggcctttctgatggccctgaccgacagcggccccaagacaaacatcatcgtggattcccagtacgtgatgggcatctccaagccttctttccaggagtttgtggactgggagaacgtgagcccagagctgaattccaccgatcagccattctggcaggcaggaatcctggcaaggaacctggtgcctatggtggccacagtgcagggccagaatctgaagtaccagggccagagcctggtcatcagcgcctccatcatcgtgtttaacctgctggagctggagggcgactatcgggacgatggcaacgtgtgggtgcacaccccactgagccccagaacactgaacgcctgggtgaaggccgtggaggagaagaagggcatcccagtgcacctggagctggcctccatgaccaatatggagctgatgtctagcatcgtgcaccagcaggtgaggacatacggacccgtgttcatgtgcctgggaggcctgctgaccatggtggcaggagccgtgtggctgacagtgcgggtgctggagctgttcagagccgcccagctggccaacgatgtggtgctgcagatcatggagctgtgcggagcagcctttcgccaggtgtgccacaccacagtgccatggcccaatgcctccctgacccccaagtggaacaatgagacaacacagcctcagatcgccaactgtagcgtgtacgacttcttcgtgtggctgcactactatagcgtgagggataccctgtggccccgcgtgacataccacatgaataagtacgcctatcacatgctggagaggcgcgccaagtataagagaggccctggcccaggcgcaaagtttgtggcagcatggaccctgaaggccgccgccggccccggccccggccagtatatcaaggctaacagtaagttcattggaatcacagagctgggacccggacctggataatgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgctctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgtccgatcctggtcgagcgcgagcaaggacagacccttctgactctgtactgcatctgcaaccaccccggcctgcatgaaagtctttgttgtctgctgtgtactgagtataataaaagctgagatcagcgactactccggacttccgtgtgttcctgaatccatcaaccagtctttgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactaacctccaccaacgccaccgtcgcgacggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggatgcggtggccatccaccagtgcaagagaggcatcttctgcctggtgaaacaggccaagatctcctacgaggtcactccaaacgaccatcgcctctcctacgagctcctgcagcagcgccagaagttcacctgcctggtcggagtcaaccccatcgtcatcacccagcagtctggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcgtgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 13 - DNA, 30684 bp, synthetic construct
  misc_feature 1..30684: note = Description of Artificial Sequence: Synthetic polynucleotide
  source 1..30684: mol_type = other DNA
ccatcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggaacgccatccacgctgttttgacctccatagaagacagcgatcgcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctttacaagtagtgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 14 - DNA, 8602 bp, synthetic construct
  misc_feature 1..8602: note = Description of Artificial Sequence: Synthetic polynucleotide
  source 1..8602: mol_type = other DNA
atgggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgctggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgactctagaatagtctttaattaaagtccgccatatgaggccaccatgcagatcttcgtgaagaccctgaccggcaagaccatcaccctagaggtggagcccagtgacaccatcgagaacgtgaaggccaagatccaggataaagagggcatcccccctgaccagcagaggctgatctttgccggcaagcagctggaagatggccgcaccctctctgattacaacatccagaaggagtcaaccctgcacctggtccttcgcctgagaggtggcgctgcttacagtataatcaactttgaaaaactggctgcttacggcatcctgggctttgtgtttacactggctgcctacctgctgtttggctatcctgtgtacgtggccgcttatggactgtgtaccctggtggccatgctggctgcttacaatctggtgcctatggtggccacagtggccgcctattgtcttggcggactgctgacaatggtggcagcctacagcccgagctatgcgtatcatcagtttgcagcctacggcccaggaccaggcgctaaatttgtggctgcctggacactgaaagccgccgctggaccaggtcctggacagtacatcaaggccaacagcaagttcatcggcatcaccgaactcggcccaggaccaggctatccctacgatgtgcctgattacgcctgatagtgatgattcgaacggccgtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttattttttcttttcttttccgaatcggattttgtttttaatatttcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 15 - DNA, 9595 bp, synthetic construct
  misc_feature 1..9595: note = Description of Artificial Sequence: Synthetic polynucleotide
  source 1..9595: mol_type = other DNA
atgggcggcgcatgagagaagcccagaccaattacctacccaaaatggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgctggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctcagaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgactctagaatagtctttaattaaagtccgccatatgagatggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaattcgaacggccgtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattgaatacagcagcaattggcaagctgcttacatagaactcgcggcgattggcatgccgccttaaaatttttattttattttttcttttcttttccgaatcggattttgtttttaatatttcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16 - protein, 139 aa, synthetic construct
  REGION 1..139: note = Description of Artificial Sequence: Synthetic polypeptide
PSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKV

SEQ ID NO: 17 - protein, 167 aa, synthetic construct
  REGION 1..167: note = Description of Artificial Sequence: Synthetic polypeptide
GVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVH

SEQ ID NO: 18 - protein, 10 aa, synthetic construct
  REGION 1..10: note = Description of Artificial Sequence: Synthetic peptide
GFTFSSYGMH

SEQ ID NO: 19 - protein, 15 aa, synthetic construct
  REGION 1..15: note = Description of Artificial Sequence: Synthetic peptide
VIWYDGSNKYYADSV

SEQ ID NO: 20 - protein, 16 aa, synthetic construct
  REGION 1..16: note = Description of Artificial Sequence: Synthetic peptide
DPRGATLYYYYYGMDV

SEQ ID NO: 21 - protein, 11 aa, synthetic construct
  REGION 1..11: note = Description of Artificial Sequence: Synthetic peptide
RASQSINSYLD

SEQ ID NO: 22 - protein, 7 aa, synthetic construct
  REGION 1..7: note = Description of Artificial Sequence: Synthetic peptide
AASSLQS

SEQ ID NO: 23 - protein, 9 aa, synthetic construct
  REGION 1..9: note = Description of Artificial Sequence: Synthetic peptide
QQYYSTPFT

SEQ ID NO: 24 - protein, 108 aa, synthetic construct
  REGION 1..108: note = Description of Artificial Sequence: Synthetic polypeptide
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 25 - protein, 121 aa, synthetic construct
  REGION 1..121: note = Description of Artificial Sequence: Synthetic polypeptide
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 26 - protein, 5 aa, synthetic construct
  REGION 1..5: note = Description of Artificial Sequence: Synthetic peptide
RYWMS

SEQ ID NO: 27 - protein, 17 aa, synthetic construct
  REGION 1..17: note = Description of Artificial Sequence: Synthetic peptide
NIKQDGSEKYYVDSVKG

SEQ ID NO: 28 - protein, 12 aa, synthetic construct
  REGION 1..12: note = Description of Artificial Sequence: Synthetic peptide
EGGWFGELAFDY

SEQ ID NO: 29 - protein, 12 aa, synthetic construct
  REGION 1..12: note = Description of Artificial Sequence: Synthetic peptide
RASQRVSSSYLA

SEQ ID NO: 30 - protein, 7 aa, synthetic construct
  REGION 1..7: note = Description of Artificial Sequence: Synthetic peptide
DASSRAT

SEQ ID NO: 31 - protein, 9 aa, synthetic construct
  REGION 1..9: note = Description of Artificial Sequence: Synthetic peptide
QQYGSLPWT

SEQ ID NO: 32 - DNA, 2019 bp, synthetic construct
  misc_feature 1..2019: note = Description of Artificial Sequence: Synthetic polynucleotide
  source 1..2019: mol_type = other DNA
gcccgggcatttaaatgcgatcgcatcgattacgactctagaatagtctagtccgcaggccaccatgcagatcttcgtgaagaccctgaccggcaagaccatcaccctagaggtggagcccagtgacaccatcgagaacgtgaaggccaagatccaggataaagagggcatcccccctgaccagcagaggctgatctttgccggcaagcagctggaagatggccgcaccctctctgattacaacatccagaaggagtcaaccctgcacctggtccttcgcctgagaggtgccatgtttcaggcgctgagcgaaggctgcaccccgtatgatattaaccagatgctgaacgtgctgggcgatcatcaggtctcaggccttgagcagcttgagagtataatcaactttgaaaaactgactgaatggaccagttctaatgttatgcctatcctgtctcctctgacaaagggcatcctgggcttcgtgtttaccctgaccgtgccttctgagagaggacttagctgcattagcgaagcggatgcgaccaccccggaaagcgcgaacctgggcgaagaaattctgagccagctgtatctttggccaagggtgacctaccattcccctagttatgcttaccaccaatttgaaagacgagccaaatataaaagacacttccccggctttggccagagcctgctgtttggctaccctgtgtacgtgttcggcgattgcgtgcagggcgattgggatgcgattcgctttcgctattgcgcgccgccgggctatgcgctgctgcgctgcaacgataccaactatagcgctctgctggctgtgggggccctagaaggacccaggaatcaggactggcttggtgtcccaagacaacttgtaactcggatgcaggctattcagaatgccggcctgtgtaccctggtggccatgctggaagagacaatcttctggctgcaagcgtttctgatggcgctgaccgatagcggcccgaaaaccaacattattgtggatagccagtatgtgatgggcattagcaaaccgagctttcaggaatttgtggattgggaaaacgtgagcccggaactgaacagcaccgatcagccgttttggcaagccggaatcctggccagaaatctggtgcctatggtggccacagtgcagggccagaacctgaagtaccagggtcagtcactagtcatctctgcttctatcattgtcttcaacctgctggaactggaaggtgattatcgagatgatggcaacgtgtgggtgcataccccgctgagcccgcgcaccctgaacgcgtgggtgaaagcggtggaagaaaaaaaaggtattccagttcacctagagctggccagtatgaccaacatggagctcatgagcagtattgtgcatcagcaggtcagaacatacggccccgtgttcatgtgtctcggcggactgcttacaatggtggctggtgctgtgtggctgacagtgcgagtgctcgagctgttccgggccgcgcagctggccaacgacgtggtcctccagatcatggagctttgtggtgcagcgtttcgccaggtgtgccataccaccgtgccgtggccgaacgcgagcctgaccccgaaatggaacaacgaaaccacccagccccagatcgccaactgcagcgtgtatgacttttttgtgtggctccattattattctgttcgagacacactttggccaagggtgacctaccatatgaacaaatatgcgtatcatatgctggaaagacgagccaaatataaaagaggaccaggacctggcgctaaatttgtggccgcctggacactgaaagccgctgctggtcctggacctggccagtacatcaaggccaacagcaagttcatcggcatcaccgaactcggacccggaccaggctgatgatttcgaaatttaaataagcttgcggccgctagggataacagggtaattatcacgcccaaacatttacagccgcggtgtcaaaaaccgcgtgg

SEQ ID NO: 33 - protein, 619 aa, synthetic construct
  REGION 1..619: note = Description of Artificial Sequence: Synthetic polypeptide
MQIFVKTLTGKTITLEVEPSDTIENVKAKIQDKEGIPPDQQRLIFAGKQLEDGRTLSDYNIQKESTLHLVLRLRGAMFQALSEGCTPYDINQMLNVLGDHQVSGLEQLESIINFEKLTEWTSSNVMPILSPLTKGILGFVFTLTVPSERGLSCISEADATTPESANLGEEILSQLYLWPRVTYHSPSYAYHQFERRAKYKRHFPGFGQSLLFGYPVYVFGDCVQGDWDAIRFRYCAPPGYALLRCNDTNYSALLAVGALEGPRNQDWLGVPRQLVTRMQAIQNAGLCTLVAMLEETIFWLQAFLMALTDSGPKTNIIVDSQYVMGISKPSFQEFVDWENVSPELNSTDQPFWQAGILARNLVPMVATVQGQNLKYQGQSLVISASIIVFNLLELEGDYRDDGNVWVHTPLSPRTLNAWVKAVEEKKGIPVHLELASMTNMELMSSIVHQQVRTYGPVFMCLGGLLTMVAGAVWLTVRVLELFRAAQLANDVVLQIMELCGAAFRQVCHTTVPWPNASLTPKWNNETTQPQIANCSVYDFFVWLHYYSVRDTLWPRVTYHMNKYAYHMLERRAKYKRGPGPGAKFVAAWTLKAAAGPGPGQYIKANSKFIGITELGPGPG

SEQ ID NO: 34 - DNA, 1638 bp, synthetic construct
  misc_feature 1..1638: note = Description of Artificial Sequence: Synthetic polynucleotide
  source 1..1638: mol_type = other DNA
atggccgggatgttccaggcactgtccgaaggctgcacaccctatgatattaaccagatgctgaatgtcctgggagaccaccaggtctctggcctggagcagctggagagcatcatcaacttcgagaagctgaccgagtggacaagctccaatgtgatgcctatcctgtccccactgaccaagggcatcctgggcttcgtgtttaccctgacagtgccttctgagcggggcctgtcttgcatcagcgaggcagacgcaaccacaccagagtccgccaatctgggcgaggagatcctgtctcagctgtacctgtggccccgggtgacatatcactccccttcttacgcctatcaccagttcgagcggagagccaagtacaagagacacttcccaggctttggccagtctctgctgttcggctaccccgtgtacgtgttcggcgattgcgtgcagggcgactgggatgccatccggtttagatactgcgcaccacctggatatgcactgctgaggtgtaacgacaccaattattccgccctgctggcagtgggcgccctggagggccctcgcaatcaggattggctgggcgtgccaaggcagctggtgacacgcatgcaggccatccagaacgcaggcctgtgcaccctggtggcaatgctggaggagacaatcttctggctgcaggcctttctgatggccctgaccgacagcggccccaagacaaacatcatcgtggattcccagtacgtgatgggcatctccaagccttctttccaggagtttgtggactgggagaacgtgagcccagagctgaattccaccgatcagccattctggcaggcaggaatcctggcaaggaacctggtgcctatggtggccacagtgcagggccagaatctgaagtaccagggccagagcctggtcatcagcgcctccatcatcgtgtttaacctgctggagctggagggcgactatcgggacgatggcaacgtgtgggtgcacaccccactgagccccagaacactgaacgcctgggtgaaggccgtggaggagaagaagggcatcccagtgcacctggagctggcctccatgaccaatatggagctgatgtctagcatcgtgcaccagcaggtgaggacatacggacccgtgttcatgtgcctgggaggcctgctgaccatggtggcaggagccgtgtggctgacagtgcgggtgctggagctgttcagagccgcccagctggccaacgatgtggtgctgcagatcatggagctgtgcggagcagcctttcgccaggtgtgccacaccacagtgccatggcccaatgcctccctgacccccaagtggaacaatgagacaacacagcctcagatcgccaactgtagcgtgtacgacttcttcgtgtggctgcactactatagcgtgagggataccctgtggccccgcgtgacataccacatgaataagtacgcctatcacatgctggagaggcgcgccaagtataagagaggccctggcccaggcgcaaagtttgtggcagcatggaccctgaaggccgccgccggccccggccccggccagtatatcaaggctaacagtaagttcattggaatcacagagctgggacccggacctgga

SEQ ID NO: 35 - protein, 546 aa, synthetic construct
  REGION 1..546: note = Description of Artificial Sequence: Synthetic polypeptide
MAGMFQALSEGCTPYDINQMLNVLGDHQVSGLEQLESIINFEKLTEWTSSNVMPILSPLTKGILGFVFTLTVPSERGLSCISEADATTPESANLGEEILSQLYLWPRVTYHSPSYAYHQFERRAKYKRHFPGFGQSLLFGYPVYVFGDCVQGDWDAIRFRYCAPPGYALLRCNDTNYSALLAVGALEGPRNQDWLGVPRQLVTRMQAIQNAGLCTLVAMLEETIFWLQAFLMALTDSGPKTNIIVDSQYVMGISKPSFQEFVDWENVSPELNSTDQPFWQAGILARNLVPMVATVQGQNLKYQGQSLVISASIIVFNLLELEGDYRDDGNVWVHTPLSPRTLNAWVKAVEEKKGIPVHLELASMTNMELMSSIVHQQVRTYGPVFMCLGGLLTMVAGAVWLTVRVLELFRAAQLANDVVLQIMELCGAAFRQVCHTTVPWPNASLTPKWNNETTQPQIANCSVYDFFVWLHYYSVRDTLWPRVTYHMNKYAYHMLERRAKYKRGPGPGAKFVAAWTLKAAAGPGPGQYIKANSKFIGITELGPGPG

SEQ ID NO: 36 - DNA, 2019 bp, synthetic construct
  misc_feature 1..2019: note = Description of Artificial Sequence: Synthetic polynucleotide
  source 1..2019: mol_type = other DNA
gcccgggcatttaaatgcgatcgcatcgattacgactctagaatagtctagtccgcaggccaccatgcagatcttcgtgaagaccctgaccggcaagaccatcaccctagaggtggagcccagtgacaccatcgagaacgtgaaggccaagatccaggataaagagggcatcccccctgaccagcagaggctgatctttgccggcaagcagctggaagatggccgcaccctctctgattacaacatccagaaggagtcaaccctgcacctggtccttcgcctgagaggtgccatgtttcaggcgctgagcgaaggctgcaccccgtatgatattaaccagatgctgaacgtgctgggcgatcatcagtttaagcacatcaaagcctttgaccggacatttgctaacaacccaggtcccatggttgtgtttgccacacctgggcctatcctgtctcctctgacaaagggcatcctgggcttcgtgtttaccctgaccgtgccttctgagagaggacttagctgcattagcgaagcggatgcgaccaccccggaaagcgcgaacctgggcgaagaaattctgagccagctgtatctttggccaagggtgacctaccattcccctagttatgcttaccaccaatttgaaagacgagccaaatataaaagacacttccccggctttggccagagcctgctgtttggctaccctgtgtacgtgttcggcgattgcgtgcagggcgattgggatgcgattcgctttcgctattgcgcgccgccgggctatgcgctgctgcgctgcaacgataccaactatagcgctctgctggctgtgggggccctagaaggacccaggaatcaggactggcttggtgtcccaagacaacttgtaactcggatgcaggctattcagaatgccggcctgtgtaccctggtggccatgctggaagagacaatcttctggctgcaagcgtttctgatggcgctgaccgatagcggcccgaaaaccaacattattgtggatagccagtatgtgatgggcattagcaaaccgagctttcaggaatttgtggattgggaaaacgtgagcccggaactgaacagcaccgatcagccgttttggcaagccggaatcctggccagaaatctggtgcctatggtggccacagtgcagggccagaacctgaagtaccagggtcagtcactagtcatctctgcttctatcattgtcttcaacctgctggaactggaaggtgattatcgagatgatggcaacgtgtgggtgcataccccgctgagcccgcgcaccctgaacgcgtgggtgaaagcggtggaagaaaaaaaaggtattccagttcacctagagctggccagtatgaccaacatggagctcatgagcagtattgtgcatcagcaggtcagaacatacggccccgtgttcatgtgtctcggcggactgcttacaatggtggctggtgctgtgtggctgacagtgcgagtgctcgagctgttccgggccgcgcagctggccaacgacgtggtcctccagatcatggagctttgtggtgcagcgtttcgccaggtgtgccataccaccgtgccgtggccgaacgcgagcctgaccccgaaatggaacaacgaaaccacccagccccagatcgccaactgcagcgtgtatgacttttttgtgtggctccattattattctgttcgagacacactttggccaagggtgacctaccatatgaacaaatatgcgtatcatatgctggaaagacgagccaaatataaaagaggaccaggacctggcgctaaatttgtggccgcctggacactgaaagccgctgctggtcctggacctggccagtacatcaaggccaacagcaagttcatcggcatcaccgaactcggacccggaccaggctgatgatttcgaaatttaaataagcttgcggccgctagggataacagggtaattatcacgcccaaacatttacagccgcggtgtcaaaaaccgcgtgg

SEQ ID NO: 37 - protein, 619 aa, synthetic construct
  REGION 1..619: note = Description of Artificial Sequence: Synthetic polypeptide
MQIFVKTLTGKTITLEVEPSDTIENVKAKIQDKEGIPPDQQRLIFAGKQLEDGRTLSDYNIQKESTLHLVLRLRGAMFQALSEGCTPYDINQMLNVLGDHQFKHIKAFDRTFANNPGPMVVFATPGPILSPLTKGILGFVFTLTVPSERGLSCISEADATTPESANLGEEILSQLYLWPRVTYHSPSYAYHQFERRAKYKRHFPGFGQSLLFGYPVYVFGDCVQGDWDAIRFRYCAPPGYALLRCNDTNYSALLAVGALEGPRNQDWLGVPRQLVTRMQAIQNAGLCTLVAMLEETIFWLQAFLMALTDSGPKTNIIVDSQYVMGISKPSFQEFVDWENVSPELNSTDQPFWQAGILARNLVPMVATVQGQNLKYQGQSLVISASIIVFNLLELEGDYRDDGNVWVHTPLSPRTLNAWVKAVEEKKGIPVHLELASMTNMELMSSIVHQQVRTYGPVFMCLGGLLTMVAGAVWLTVRVLELFRAAQLANDVVLQIMELCGAAFRQVCHTTVPWPNASLTPKWNNETTQPQIANCSVYDFFVWLHYYSVRDTLWPRVTYHMNKYAYHMLERRAKYKRGPGPGAKFVAAWTLKAAAGPGPGQYIKANSKFIGITELGPGPG

SEQ ID NO: 38 - DNA, 228 bp, synthetic construct
  misc_feature 1..228: note = Description of Artificial Sequence: Synthetic polynucleotide
  source 1..228: mol_type = other DNA
atgcagatcttcgtgaagaccctgaccggcaagaccatcaccctagaggtggagcccagtgacaccatcgagaacgtgaaggccaagatccaggataaagagggcatcccccctgaccagcagaggctgatctttgccggcaagcagctggaagatggccgcaccctctctgattacaacatccagaaggagtcaaccctgcacctggtccttcgcctgagaggtggc

SEQ ID NO: 39 - DNA, 228 bp, synthetic construct
  misc_feature 1..228: note = Description of Artificial Sequence: Synthetic polynucleotide
  source 1..228: mol_type = other DNA
atgcagatcttcgtgaagaccctgaccggcaagaccatcaccctagaggtggagcccagtgacaccatcgagaacgtgaaggccaagatccaggataaagagggcatcccccctgaccagcagaggctgatctttgccggcaagcagctggaagatggccgcaccctctctgattacaacatccagaaggagtcaaccctgcacctggtccttcgcctgagaggtgcc

SEQ ID NO: 40 - DNA, 78 bp, Homo sapiens
  source 1..78: mol_type = other DNA
atggccgtcatggcgccccgaaccctcgtcctgctactctcgggggctctggccctgacccagacctgggcgggctct

SEQ ID NO: 41 - DNA, 201 bp, Homo sapiens
  source 1..201: mol_type = other DNA
ccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtga

SEQ ID NO: 42 - DNA, 60 bp, synthetic construct
  misc_feature 1..60: note = Description of Artificial Sequence: Synthetic oligonucleotide
  source 1..60: mol_type = other DNA
atggagaccgatacactgctgctgtgggtgctgctcctgtgggtgccaggaagcacaggc

SEQ ID NO: 43 - DNA, 3178 bp, Homo sapiens
  source 1..3178: mol_type = other DNA
ggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacagctggaaccagttcatcaaccgtcagccacacaactgggaacaccactcaacccagtaaccagaccacccttccagcaactttatcgatagcactgcacaaaagcacaaccggtcagaagcctgatcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacgggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaattgctagactaagaattaggtggctacagatggtagaactaaacaataagcaagagacaataataatggcccttaattattaacaaagtgccagagtctaggctaagcactttatctatatctcatttcattctcacaacttataagtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgcaataaaaacttactttgg

SEQ ID NO: 44 - DNA, 1858 bp, Mus sp.
  source 1..1858: mol_type = other DNA
attccggaggtgaaaaacaatggcacaacgtgtataatggccagcttctctgcctcctttctgaccacctacgagactgcgaatggttctcagatcgtgaacatttccctgccagcctctgcagaagtactgaaaaatggcagttcttgtggtaaagaaaatgtttctgaccccagcctcacaattacttttggaagaggatatttactgacactcaacttcacaaaaaatacaacacgttacagtgtccagcatatgtattttacatataacttgtcagatacagaacattttcccaatgccatcagcaaagagatctacaccatggattccacaactgacatcaaggcagacatcaacaaagcataccggtgtgtcagtgatatccgggtctacatgaagaatgtgaccgttgtgctccgggatgccactatccaggcctacctgtcgagtggcaacttcagcaaggaagagacacactgcacacaggatggaccttccccaaccactgggccacccagcccctcaccaccacttgtgcccacaaaccccactgtatccaagtacaatgttactggtaacaacggaacctgcctgctggcctctatggcactgcaactgaatatcacctacctgaaaaaggacaacaagacggtgaccagagcgttcaacatcagcccaaatgacacatctagtgggagttgcggtatcaacttggtgaccctgaaagtggagaacaagaacagagccctggaattgcagtttgggatgaatgccagctctagcctgtttttcttgcaaggagtgcgcttgaatatgactcttcctgatgccctagtgcccacattcagcatctccaaccattcactgaaagctcttcaggccactgtgggaaactcatacaagtgcaacactgaggaacacatctttgtcagcaagatgctctccctcaatgtcttcagtgtgcaggtccaggctttcaaggtggacagtgacaggtttgggtctgtggaagagtgtgttcaggatggtaacaacatgttgatccccattgctgtgggcggtgccctggcagggctgatcctcatcgtcctcattgcctacctcattggcaggaagaggagtcacgccggctatcagaccatctagcctggtgggcaggtgcaccagagatgcacaggggcctgttctcacatccccaagcttagataggtgtggaagggaggcacactttctggcaaactgttttaaaatctgctttatcaaatgtgaagttcatcttgcaacatttactatgcacaaaggaataactattgaaatgacggtgttaattttgctaactgggttaaatattgatgagaaggctccactgatttgacttttaagacttggtgtttggttcttcattcttttactcagatttaagcctatcaaagggatactctggtccagaccttggcctggcaagggtggctgatggttaggctgcacacacttaagaagcaacgggagcagggaaggcttgcacacaggcacgcacagggtcaacctctggacacttggcttgggctacctggccttgggggggctgaactctggcatctggctgggtacacacccccccaatttctgtgctctgccacccgtgagctgccactttcctaaatagaaaatggcattatttttatttacttttttgtaaagtgatttccagtcttgtgttggcgttcagggtggccctgtctctgcactgtgtacaataatagattcacactgctgacgtgtcttgcagcgtaggtgggttgtacactgggcatcagctcacgtaatgcattgcctgtaacgatgctaataaaaa

SEQ ID NO: 45 - DNA, 2339 bp, Homo sapiens
  source 1..2339: mol_type = other DNA
ggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttaaaaaaaaaaaaaaaaaaaaaaaa

SEQ ID NO: 46 - DNA, 45 bp, synthetic construct
  misc_feature 1..45: note = Description of Artificial Sequence: Synthetic oligonucleotide
  source 1..45: mol_type = other DNA
cagtacatcaaggccaacagcaagttcatcggcatcaccgaactc

SEQ ID NO: 47 - protein, 15 aa, synthetic construct
  REGION 1..15: note = Description of Artificial Sequence: Synthetic peptide
QYIKANSKFIGITEL

SEQ ID NO: 48 - DNA, 39 bp, synthetic construct
  misc_feature 1..39: note = Description of Artificial Sequence: Synthetic oligonucleotide
  source 1..39: mol_type = other DNA
gctaaatttgtggctgcctggacactgaaagccgccgct

SEQ ID NO: 49 - protein, 13 aa, synthetic construct
  REGION 1..13: note = Description of Artificial Sequence: Synthetic peptide
AKFVAAWTLKAAA

SEQ ID NO: 50 - DNA, 593 bp, Woodchuck hepatitis virus
  source 1..593: mol_type = other DNA
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgt

SEQ ID NO: 51 - DNA, 589 bp, synthetic construct
  misc_feature 1..589: note = Description of Artificial Sequence: Synthetic polynucleotide
  source 1..589: mol_type = other DNA
tctcccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatg

SEQ ID NO: 52 - DNA, 720 bp, synthetic construct
  misc_feature 1..720: note = Description of Artificial Sequence: Synthetic polynucleotide
  source 1..720: mol_type = other DNA
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtag

SEQ ID NO: 53 - DNA, 1563 bp, synthetic construct
  misc_feature 1..1563: note = Description of Artificial Sequence: Synthetic polynucleotide
  source 1..1563: mol_type = other DNA
atgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcctaaaagggcagaagaaggacaaactggggcctgagatacccctggccatggaccgcttcccatatgtggctctgtccaagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgatcctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccgggttactctagagtcggggcggccggccgcttcgagcagacatgataa

SEQ ID NO: 54 - DNA, 1653 bp, synthetic construct
  misc_feature 1..1653: note = Description of Artificial Sequence: Synthetic polynucleotide
  source 1..1653: mol_type = other DNA
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaa

SEQ ID NO: 55 - DNA, 66 bp, Foot-and-mouth disease virus
  source 1..66: mol_type = other DNA
gtaaagcaaacactgaactttgaccttctcaagttggctggagacgttgagtccaatcctgggccc

SEQ ID NO: 56 - protein, 5 aa, synthetic construct
  REGION 1..5: note = Description of Artificial Sequence: Synthetic peptide
GPGPG

SEQ ID NO: 57 - DNA, 30876 bp, synthetic construct
  misc_feature 1..30876: note = Description of Artificial Sequence: Synthetic polynucleotide
  source 1..30876: mol_type = other DNA
catcatcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggaacgccatccacgctgttttgacctccatagaagacagcgatcgcgccaccatggccgggatgttccaggcactgtccgaaggctgcacaccctatgatattaaccagatgctgaatgtcctgggagaccaccaggtctctggcctggagcagctggagagcatcatcaacttcgagaagctgaccgagtggacaagctccaatgtgatgcctatcctgtccccactgaccaagggcatcctgggcttcgtgtttaccctgacagtgccttctgagcggggcctgtcttgcatcagcgaggcagacgcaaccacaccagagtccgccaatctgggcgaggagatcctgtctcagctgtacctgtggccccgggtgacatatcactccccttcttacgcctatcaccagttcgagcggagagccaagtacaagagacacttcccaggctttggccagtctctgctgttcggctaccccgtgtacgtgttcggcgattgcgtgcagggcgactgggatgccatccggtttagatactgcgcaccacctggatatgcactgctgaggtgtaacgacaccaattattccgccctgctggcagtgggcgccctggagggccctcgcaatcaggattggctgggcgtgccaaggcagctggtgacacgcatgcaggccatccagaacgcaggcctgtgcaccctggtggcaatgctggaggagacaatcttctggctgcaggcctttctgatggccctgaccgacagcggccccaagacaaacatcatcgtggattcccagtacgtgatgggcatctccaagccttctttccaggagtttgtggactgggagaacgtgagcccagagctgaattccaccgatcagccattctggcaggcaggaatcctggcaaggaacctggtgcctatggtggccacagtgcagggccagaatctgaagtaccagggccagagcctggtcatcagcgcctccatcatcgtgtttaacctgctggagctggagggcgactatcgggacgatggcaacgtgtgggtgcacaccccactgagccccagaacactgaacgcctgggtgaaggccgtggaggagaagaagggcatcccagtgcacctggagctggcctccatgaccaatatggagctgatgtctagcatcgtgcaccagcaggtgaggacatacggacccgtgttcatgtgcctgggaggcctgctgaccatggtggcaggagccgtgtggctgacagtgcgggtgctggagctgttcagagccgcccagctggccaacgatgtggtgctgcagatcatggagctgtgcggagcagcctttcgccaggtgtgccacaccacagtgccatggcccaatgcctccctgacccccaagtggaacaatgagacaacacagcctcagatcgccaactgtagcgtgtacgacttcttcgtgtggctgcactactatagcgtgagggataccctgtggccccgcgtgacataccacatgaataagtacgcctatcacatgctggagaggcgcgccaagtataagagaggccctggcccaggcgcaaagtttgtggcagcatggaccctgaaggccgccgccggccccggccccggccagtatatcaaggctaacagtaagttcattggaatcacagagctgggacccggacctggataatgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggttccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 58 - DNA, 29955 bp, synthetic construct
  misc_feature 1..29955: note = Description of Artificial Sequence: Synthetic polynucleotide
  source 1..29955: mol_type = other DNA
catcatcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggaacgccatccacgctgttttgacctccatagaagacagcgatcgcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctttacaagtagtgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggttccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 59 - DNA, 28278 bp, synthetic construct
  misc_feature 1..28278: note = Description of Artificial Sequence: Synthetic polynucleotide
  source 1..28278: mol_type = other DNA
catcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 60 - DNA, 19 bp, synthetic construct
  misc_feature 1..19: note = Description of Artificial Sequence: Synthetic oligonucleotide
  source 1..19: mol_type = other DNA
tccctatcagtgatagaga

SEQ ID NO: 61 - DNA, 410 bp, synthetic construct
  misc_feature 1..410: note = Description of Artificial Sequence: Synthetic polynucleotide
  source 1..410: mol_type = other DNA
ccatgttgacattgattattgactagttattaaagtacttccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagctcggtacccgggtcgaggtaggcgtgtacggtgggaggcctatataagcagagctcgtttagtgaaccgtcagatcgcctggag

SEQ ID NO: 62 - DNA, 849 bp, synthetic construct
  misc_feature 1..849: note = Description of Artificial Sequence: Synthetic polynucleotide
  source 1..849: mol_type = other DNA
atgagcagactggacaagagcaaagtgatcaacagcgccctggaactgctgaacgaagtgggcatcgagggcctgacaaccagaaagctggcccagaagctgggcgttgagcagcctacactgtattggcacgtgcggaacaagcagaccctgatgaatatgctgagcgaggccatcctggccaagcaccatacaagatctgcccctctgccaaccgagagctggcagcagtttctgcaagagaacgccctgagcttcagaaaggccctgctggtgcatagagatggcgccagactgcacatcggcacatctcccacacctccacagtttgagcaggctgaggcacagctgagatgtctgtgtgatgccggctttagcgtggaagaggccctgttcatcctgcagtccatcagccactttacactgggcgccgtgctggaagaacaggccaccaaccagatcgagaacaaccacgtgatcgacgctgcccctccactgctgcaagaggccttcaatatccaagccagaaccagcgccgagatggccttccactttggcctgaagtccctgatctttggcttcagcgcccagctggacgagaagaagcacacacctatcgaggacggcaacaagcccaagaagaagcggaagctggccgtcagcgtgacctttgaagatgtggccgtgctgttcacccgggacgagtggaagaaactggacctgagccagcggagcctgtaccgggaagtgatgctggaaaactacagcaacctggcctccatggccggctttctgttcaccaagcctaaagtgatctccctgcttcagcagggcgaagatccttggtaa

SEQ ID NO: 63 - protein, 282 aa, synthetic construct
  REGION 1..282: note = Description of Artificial Sequence: Synthetic polypeptide
MSRLDKSKVINSALELLNEVGIEGLTTRKLAQKLGVEQPTLYWHVRNKQTLMNMLSEAILAKHHTRSAPLPTESWQQFLQENALSFRKALLVHRDGARLHIGTSPTPPQFEQAEAQLRCLCDAGFSVEEALFILQSISHFTLGAVLEEQATNQIENNHVIDAAPPLLQEAFNIQARTSAEMAFHFGLKSLIFGFSAQLDEKKHTPIEDGNKPKKKRKLAVSVTFEDVAVLFTRDEWKKLDLSQRSLYREVMLENYSNLASMAGFLFTKPKVISLLQQGEDPW

SEQ ID NO: 64 - DNA, 627 bp, synthetic construct
  misc_feature 1..627: note = Description of Artificial Sequence: Synthetic polynucleotide
  source 1..627: mol_type = other DNA
gacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctctccctatcagtgatagagatctccctatcagtgatagagatc

SEQ ID NO: 65 - DNA, 31402 bp, synthetic construct
  misc_feature 1..31402: note = Description of Artificial Sequence: Synthetic polynucleotide
  source 1..31402: mol_type = other DNA
catcatcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatccatgttgacattgattattgactagttattaaagtacttccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagctcggtacccgggtcgaggtaggcgtgtacggtgggaggcctatataagcagagctcgtttagtgaaccgtcagatcgcctggagacgccatccacgctgttttgacctccatagaagacagcgatcgcgccaccatggccgggatgttccaggcactgtccgaaggctgcacaccctatgatattaaccagatgctgaatgtcctgggagaccaccaggtctctggcctggagcagctggagagcatcatcaacttcgagaagctgaccgagtggacaagctccaatgtgatgcctatcctgtccccactgaccaagggcatcctgggcttcgtgtttaccctgacagtgccttctgagcggggcctgtcttgcatcagcgaggcagacgcaaccacaccagagtccgccaatctgggcgaggagatcctgtctcagctgtacctgtggccccgggtgacatatcactccccttcttacgcctatcaccagttcgagcggagagccaagtacaagagacacttcccaggctttggccagtctctgctgttcggctaccccgtgtacgtgttcggcgattgcgtgcagggcgactgggatgccatccggtttagatactgcgcaccacctggatatgcactgctgaggtgtaacgacaccaattattccgccctgctggcagtgggcgccctggagggccctcgcaatcaggattggctgggcgtgccaaggcagctggtgacacgcatgcaggccatccagaacgcaggcctgtgcaccctggtggcaatgctggaggagacaatcttctggctgcaggcctttctgatggccctgaccgacagcggccccaagacaaacatcatcgtggattcccagtacgtgatgggcatctccaagccttctttccaggagtttgtggactgggagaacgtgagcccagagctgaattccaccgatcagccattctggcaggcaggaatcctggcaaggaacctggtgcctatggtggccacagtgcagggccagaatctgaagtaccagggccagagcctggtcatcagcgcctccatcatcgtgtttaacctgctggagctggagggcgactatcgggacgatggcaacgtgtgggtgcacaccccactgagccccagaacactgaacgcctgggtgaaggccgtggaggagaagaagggcatcccagtgcacctggagctggcctccatgaccaatatggagctgatgtctagcatcgtgcaccagcaggtgaggacatacggacccgtgttcatgtgcctgggaggcctgctgaccatggtggcaggagccgtgtggctgacagtgcgggtgctggagctgttcagagccgcccagctggccaacgatgtggtgctgcagatcatggagctgtgcggagcagcctttcgccaggtgtgccacaccacagtgccatggcccaatgcctccctgacccccaagtggaacaatgagacaacacagcctcagatcgccaactgtagcgtgtacgacttcttcgtgtggctgcactactatagcgtgagggataccctgtggccccgcgtgacataccacatgaataagtacgcctatcacatgctggagaggcgcgccaagtataagagaggccctggcccaggcgcaaagtttgtggcagcatggaccctgaaggccgccgccggccccggccccggccagtatatcaaggctaacagtaagttcattggaatcacagagctgggacccggacctggataatgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 66 - DNA, 31627 bp, synthetic construct
  misc_feature 1..31627: note = Description of Artificial Sequence: Synthetic polynucleotide
  source 1..31627: mol_type = other DNA
catcatcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggaacgccatccacgctgttttgacctccatagaagacagcgatcgcgccaccatggctggcatgaccgagtacaagctggtggtagtgggagcaggggatgttggaaaatcagccttgactattcagctcatccagggcacagatctggatcaccaggagaaatgtctctcgcgactgtacgaccacatgcctgagggtctgaccccccttatgggagtgtcgtcctcttctgcgctggcccgtctcggattacccatggataaactcaataaaatcaccgccccggcgagccagaagttaagacaactgcaaaagatggaaactcctgaactactgccctgtgggtatcttgtagaagaaaataccacgatctctgtgacagtgaagggcctggaggctcagaataagatcaaagggtgcactgggtcggtgaacatgactttacagagagccagcgcagctcctaagactggtggcgggggtgaagccgctgcatacaacaacactcttgtggcacggcacgtgccccagataccaaagcccgattccttggtggggcttagtgatgagttggggaagcgggacacttttgcagagtctctgattcgtaggatggcatccgcgggctacctgttcctggacatcatcacatacgtggtctttgctgtaaccttcgtgcttggtgttttaggagggctgaacacagaaaccaatgagaaggctttagaagctgtgtttggcaagtatggaagaatagtggaggtgctggggggccggtcatgcgaggagctgacggcggtacttcctccacctcagcttttgggcaggagatttaacttcttctcatactcctatgtggccgcaggaagttccgggaataactatgacctcatggcccaacccatcacgcccgggcccgacacaaccccgttaccagtgaccgatactagttccgtgagtacaggccacgccaccagcctgcctgtgactgacgctggactcagggttacagagagtaaggggcacagcgattcatggcacctgtctttggatacggccatcagggtcaacacccctaaactggtgtccgaggttgaggaactcaacaaaagcattacagcgctacgagaaaagctactgcagatggtggaggccgacagacccggaaacctcttcattgggggcttaaatacagagactaatgaagacagcccggtcaaggatgaagtagtggtgaatgatcagtggggacagaactgcagctgccaccacggcggttacgagtttccggacctgcaccgcaccatcgtgtctgagtgtgacgtgtacctcacctacatgctgcgccaggccgcccttcagctgttctttgatctctaccactccattccgtcaagcttcagccccttagtcctcagctgtttagtgcagcccttggaagatgtggaggtcatggagaaggacggcaccacattctcctgtgaagtttctcatgacgaggttcctcggacatatggacccgtgtttatgtgtctgggaggactgctgaccatggtggctggagctgtttggctgacagttggacccggaccaggcgccaaatttgttgctgcttggacactgaaagctgctgctgggcccggaccaggccagtacatcaaggccaactctaagtttatcggcatcaccgaattgggacctggacccggctagtagtgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 67 - DNA, 31427 bp, synthetic construct
  misc_feature 1..31427: note = Description of Artificial Sequence: Synthetic polynucleotide
  source 1..31427: mol_type = other DNA
ccatcttcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatccatgttgacattgattattgactagttattaaagtacttccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagctcggtacccgggtcgaggtaggcgtgtacggtgggaggcctatataagcagagctcgtttagtgaaccgtcagatcgcctggagacgccatccacgctgttttgacctccatagaagacagcgatcgcgccaccatggctggcatgaccgagtacaagctagtcgttgtgggagctggagatgtgggcaaatctgctctgaccattcagctgattcagggcacagatctggatcaccaggagaagtgtctgagcaggctgtacgaccacatgccagaaggattaacccctcttatgggagtgagctcttcttctgctctggccagactgggactgcctatggataagctgaacaagatcacagctcctgcctctcagaaactgagacagctgcagaagatggagacccctgaactgctgccttgtggatatctggtggaggagaataccacaatcagcgtgaccgtgaaaggcctggaagcccagaacaagatcaaaggctgtaccggctctgtgaatatgacactgcagagagcttctgccgcccctaagacaggaggaggaggagaagctgctgcctacaataatacattagtggccagacatgtgccccagatccctaagcctgacagcctggttggcctgagcgatgaattaggaaaaagagacacatttgccgagagcctgatccggagaatggcctctgccggctacctgttcctggatatcatcacatatgttgtgtttgccgtgaccttcgtgctgggagttctgggcggcctgaataccgagaccaatgaaaaagctcttgaagccgtgtttggcaagtacggcagaatcgtggaggtgctgggcggcagatcttgtgaagaattaacagctgtgttaccacctcctcagctgcttggcagacggttcaacttcttcagctacagctacgttgctgctggctcttctggcaacaactacgacctgatggcccagcctattacacctggacctgatacaacacctctgcctgtgaccgatacatcttctgtgtctaccggacacgccacatctctgccagtgacagatgctggactgagagtgacagagtctaaaggacacagcgattcttggcacctgagcctggatacagccatcagggtgaatacccctaagctggtttctgaagtggaagagctgaacaagagcatcaccgccctgagggagaagttactgcagatggtggaagccgatagacctggaaacctgtttattggaggcctgaacaccgagaccaatgaggactctcccgtgaaggatgaagtggtggtgaacgatcaatggggccagaattgtagctgccatcatggaggctacgagttccctgatctgcacaggacaatcgtgtctgagtgcgatgtgtatctgacctacatgctgagacaggctgctctgcagctgttcttcgacctgtatcacagcatccctagcagcttttctcctctggttctgagctgtctggtgcagcctctggaagatgtggaagtgatggagaaggatggcacaacctttagctgtgaggtgagccacgatgaggtgcctcggacatatggacccgtgtttatgtgtctgggaggactgctgaccatggtggctggagctgtttggctgacagttggacccggaccaggcgccaaatttgttgctgcttggacactgaaagctgctgctgggcccggaccaggccagtacatcaaggccaactctaagtttatcggcatcaccgaattgggacctggacccggctagtagtgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatgg

SEQ ID NO: 68 - DNA, 31681 bp, synthetic construct
  misc_feature 1..31681: note = Description of Artificial Sequence: Synthetic polynucleotide
  source 1..31681: mol_type = other DNA
catcatcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctctccctatcagtgatagagatctccctatcagtgatagagatcgtcgacgagctcgtttagtgaaccgtcagatcgcctggaacgccatccacgctgttttgacctccatagaagacagcgatcgcgccaccatggctggcatgaccgagtacaagctagtcgttgtgggagctggagatgtgggcaaatctgctctgaccattcagctgattcagggcacagatctggatcaccaggagaagtgtctgagcaggctgtacgaccacatgccagaaggattaacccctcttatgggagtgagctcttcttctgctctggccagactgggactgcctatggataagctgaacaagatcacagctcctgcctctcagaaactgagacagctgcagaagatggagacccctgaactgctgccttgtggatatctggtggaggagaataccacaatcagcgtgaccgtgaaaggcctggaagcccagaacaagatcaaaggctgtaccggctctgtgaatatgacactgcagagagcttctgccgcccctaagacaggaggaggaggagaagctgctgcctacaataatacattagtggccagacatgtgccccagatccctaagcctgacagcctggttggcctgagcgatgaattaggaaaaagagacacatttgccgagagcctgatccggagaatggcctctgccggctacctgttcctggatatcatcacatatgttgtgtttgccgtgaccttcgtgctgggagttctgggcggcctgaataccgagaccaatgaaaaagctcttgaagccgtgtttggcaagtacggcagaatcgtggaggtgctgggcggcagatcttgtgaagaattaacagctgtgttaccacctcctcagctgcttggcagacggttcaacttcttcagctacagctacgttgctgctggctcttctggcaacaactacgacctgatggcccagcctattacacctggacctgatacaacacctctgcctgtgaccgatacatcttctgtgtctaccggacacgccacatctctgccagtgacagatgctggactgagagtgacagagtctaaaggacacagcgattcttggcacctgagcctggatacagccatcagggtgaatacccctaagctggtttctgaagtggaagagctgaacaagagcatcaccgccctgagggagaagttactgcagatggtggaagccgatagacctggaaacctgtttattggaggcctgaacaccgagaccaatgaggactctcccgtgaaggatgaagtggtggtgaacgatcaatggggccagaattgtagctgccatcatggaggctacgagttccctgatctgcacaggacaatcgtgtctgagtgcgatgtgtatctgacctacatgctgagacaggctgctctgcagctgttcttcgacctgtatcacagcatccctagcagcttttctcctctggttctgagctgtctggtgcagcctctggaagatgtggaagtgatggagaaggatggcacaacctttagctgtgaggtgagccacgatgaggtgcctcggacatatggacccgtgtttatgtgtctgggaggactgctgaccatggtggctggagctgtttggctgacagttggacccggaccaggcgccaaatttgttgctgcttggacactgaaagctgctgctgggcccggaccaggccagtacatcaaggccaactctaagtttatcggcatcaccgaattgggacctggacccggctagtagtgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggttccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtggacgtttagagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 69 - DNA, 30954 bp, synthetic construct
  misc_feature 1..30954: note = Description of Artificial Sequence: Synthetic polynucleotide
  source 1..30954: mol_type = other DNA
catcatcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctctccctatcagtgatagagatctccctatcagtgatagagatcgtcgacgagctcgtttagtgaaccgtcagatcgcctggaacgccatccacgctgttttgacctccatagaagacagcgatcgcgccaccatggctggcatgaccgagtacaagctagtcgttgtgggagctggagatgtgggcaaatctgctctgaccattcagctgattcagggcacagatctggatcaccaggagaagtgtctgagcaggctgtacgaccacatgccagaaggattaacccctcttatgggagtgagctcttcttctgctctggccagactgggactgcctatggataagctgaacaagatcacagctcctgcctctcagaaactgagacagctgcagaagatggagacccctgaactgctgccttgtggatatctggtggaggagaataccacaatcagcgtgaccgtgaaaggcctggaagcccagaacaagatcaaaggctgtaccggctctgtgaatatgacactgcagagagcttctgccgcccctaagacaggaggaggaggagaagctgctgcctacaataatacattagtggccagacatgtgccccagatccctaagcctgacagcctggttggcctgagcgatgaattaggaaaaagagacacatttgccgagagcctgatccggagaatggcctctgccggctacctgttcctggatatcatcacatatgttgtgtttgccgtgaccttcgtgctgggagttctgggcggcctgaataccgagaccaatgaaaaagctcttgaagccgtgtttggcaagtacggcagaatcgtggaggtgctgggcggcagatcttgtgaagaattaacagctgtgttaccacctcctcagctgcttggcagacggttcaacttcttcagctacagctacgttgctgctggctcttctggcaacaactacgacctgatggcccagcctattacacctggacctgatacaacacctctgcctgtgaccgatacatcttctgtgtctaccggacacgccacatctctgccagtgacagatgctggactgagagtgacagagtctaaaggacacagcgattcttggcacctgagcctggatacagccatcagggtgaatacccctaagctggtttctgaagtggaagagctgaacaagagcatcaccgccctgagggagaagttactgcagatggtggaagccgatagacctggaaacctgtttattggaggcctgaacaccgagaccaatgaggactctcccgtgaaggatgaagtggtggtgaacgatcaatggggccagaattgtagctgccatcatggaggctacgagttccctgatctgcacaggacaatcgtgtctgagtgcgatgtgtatctgacctacatgctgagacaggctgctctgcagctgttcttcgacctgtatcacagcatccctagcagcttttctcctctggttctgagctgtctggtgcagcctctggaagatgtggaagtgatggagaaggatggcacaacctttagctgtgaggtgagccacgatgaggtgcctcggacatatggacccgtgtttatgtgtctgggaggactgctgaccatggtggctggagctgtttggctgacagttggacccggaccaggcgccaaatttgttgctgcttggacactgaaagctgctgctgggcccggaccaggccagtacatcaaggccaactctaagtttatcggcatcaccgaattgggacctggacccggctagtagtgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggttccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 70 - DNA, 23 bp, synthetic construct
  misc_feature 1..23: note = Description of Artificial Sequence: Synthetic oligonucleotide
  source 1..23: mol_type = other DNA
aaagtgaaagtcgagtttaccac

SEQ ID NO: 71 - DNA, 30930 bp, synthetic construct
  misc_feature 1..30930: note = Description of Artificial Sequence: Synthetic polynucleotide
  source 1..30930: mol_type = other DNA
catcatcaataatatacctcaaactttttgtgcgcgttaatatgcaaatgaggcgtttgaatttggggaggaagggcggtgattggtcgagggatgagcgaccgttaggggcggggcgagtgacgttttgatgacgtggttgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagtagggataacagggtaatgacattgattattgactagttgttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctctccctatcagtgatagagatctccctatcagtgatagagatcgtcgacgagctcgtttagtgaaccgtcagatcgcctggaacgccatccacgctgttttgacctccatagaagacagcgatcgcgccaccatggccgggatgttccaggcactgtccgaaggctgcacaccctatgatattaaccagatgctgaatgtcctgggagaccaccaggtctctggcctggagcagctggagagcatcatcaacttcgagaagctgaccgagtggacaagctccaatgtgatgcctatcctgtccccactgaccaagggcatcctgggcttcgtgtttaccctgacagtgccttctgagcggggcctgtcttgcatcagcgaggcagacgcaaccacaccagagtccgccaatctgggcgaggagatcctgtctcagctgtacctgtggccccgggtgacatatcactccccttcttacgcctatcaccagttcgagcggagagccaagtacaagagacacttcccaggctttggccagtctctgctgttcggctaccccgtgtacgtgttcggcgattgcgtgcagggcgactgggatgccatccggtttagatactgcgcaccacctggatatgcactgctgaggtgtaacgacaccaattattccgccctgctggcagtgggcgccctggagggccctcgcaatcaggattggctgggcgtgccaaggcagctggtgacacgcatgcaggccatccagaacgcaggcctgtgcaccctggtggcaatgctggaggagacaatcttctggctgcaggcctttctgatggccctgaccgacagcggccccaagacaaacatcatcgtggattcccagtacgtgatgggcatctccaagccttctttccaggagtttgtggactgggagaacgtgagcccagagctgaattccaccgatcagccattctggcaggcaggaatcctggcaaggaacctggtgcctatggtggccacagtgcagggccagaatctgaagtaccagggccagagcctggtcatcagcgcctccatcatcgtgtttaacctgctggagctggagggcgactatcgggacgatggcaacgtgtgggtgcacaccccactgagccccagaacactgaacgcctgggtgaaggccgtggaggagaagaagggcatcccagtgcacctggagctggcctccatgaccaatatggagctgatgtctagcatcgtgcaccagcaggtgaggacatacggacccgtgttcatgtgcctgggaggcctgctgaccatggtggcaggagccgtgtggctgacagtgcgggtgctggagctgttcagagccgcccagctggccaacgatgtggtgctgcagatcatggagctgtgcggagcagcctttcgccaggtgtgccacaccacagtgccatggcccaatgcctccctgacccccaagtggaacaatgagacaacacagcctcagatcgccaactgtagcgtgtacgacttcttcgtgtggctgcactactatagcgtgagggataccctgtggccccgcgtgacataccacatgaataagtacgcctatcacatgctggagaggcgcgccaagtataagagaggccctggcccaggcgcaaagtttgtggcagcatggaccctgaaggccgccgccggccccggccccggccagtatatcaaggctaacagtaagttcattggaatcacagagctgggacccggacctggataatgagtttaaactcccatttaaatgtgagggttaatgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaataactataacggtcctaaggtagcgagtgagtagtgttctggggcgggggaggacctgcatgagggccagaataactgaaatctgtgcttttctgtgtgttgcagcagcatgagcggaagcggctcctttgagggaggggtattcagcccttatctgacggggcgtctcccctcctgggcgggagtgcgtcagaatgtgatgggatccacggtggacggccggcccgtgcagcccgcgaactcttcaaccctgacctatgcaaccctgagctcttcgtcgttggacgcagctgccgccgcagctgctgcatctgccgccagcgccgtgcgcggaatggccatgggcgccggctactacggcactctggtggccaactcgagttccaccaataatcccgccagcctgaacgaggagaagctgttgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcctttgtgcccgcccaggttttccatgcactcatccatgatgatggcgatgggcccgtgggcggcggcctgggcaaagacgtttcgggggtcggacacatcatagttgtggtcctgggtgaggtcatcataggccattttaatgaatttggggcggagggtgccggactgggggacaaaggttccctcgatcccgggggcgtagttcccctcacagatctgcatctcccaggctttgagctcggagggggggatcatgtccacctgcggggcgataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacgtgcatgttctcgcgcaccagttccgccaggaggcgctctccccccagggataggagctcctggagcgaggcgaagtttttcagcggcttgagtccgtcggccatgggcattttggagagggtttgttgcaagagttccaggcggtcccagagctcggtgatgtgctctacggcatctcgatccagcagacctcctcgtttcgcgggttgggacggctgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccggccgggggggtataaaagggtgcgggtccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggtttttttccttgtcggcgcgctccttggcggcgatgttgagctgcacgtactcgcgcgccacgcacttccattcggggaagacggtggtcagctcgtcgggcacgattctgacctgccagccccgattatgcagggtgatgaggtccacactggtggccacctcgccgcgcaggggctcattagtccagcagaggcgtccgcccttgcgcgagcagaaggggggcagggggtccagcatgacctcgtcgggggggtcggcatcgatggtgaagatgccgggcaggaggtcggggtcaaagtagctgatggaagtggccagatcgtccagggcagcttgccattcgcgcacggccagcgcgcgctcgtagggactgaggggcgtgccccagggcatgggatgggtaagcgcggaggcgtacatgccgcagatgtcgtagacgtagaggggctcctcgaggatgccgatgtaggtggggtagcagcgccccccgcggatgctggcgcgcacgtagtcatacagctcgtgcgagggggcgaggagccccgggcccaggttggtgcgactgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgactaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaagtgtccctgaccatgaccttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaatcgcggacggcccttgacgtggggcagtttcttgagctcctcgtaggtgagctcgtcggggtcgctgagcccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccattggtggcgacgtcgatggcttgcagggtcccgtgcccctggggtgtgaccaccgtcccccgtttcttcttgggcggctggggcgacgggggcggtgcctcttccatggttagaagcggcggcgaggacgcgcgccgggcggcaggggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcttgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgctgaacgaaggcttcgagccagtcgcagtcgcaaggtaggctgagcacggtttcttctggcgggtcatgttggttgggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcttgctggatctgggtgagggtggtctggaagtcatcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtattggcactcccgtctcgacccaagcctgcaccaaccctccaggatacggaggcgggtcgttttgcaacttttttttggaggccggatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccatagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggacagagttatgatcaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaagcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtttgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgtgcggtgagcgccagcaggcggcgcgagctgagcgaccaggagctgatgcatagtctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcaccgaggaggagcgcatcctgcgttacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaagaggagtacttgaatgactcgctgttgagacccgagcgggagaagaacttccccaataacgggatagaaagcctggtggacaagatgagccgctggaagacgtatgcgcaggagcacagggacgatccccgggcgtcgcagggggccacgagccggggcagcgccgcccgtaaacgccggtggcacgacaggcagcggggacagatgtgggacgatgaggactccgccgacgacagcagcgtgttggacttgggtgggagtggtaacccgttcgctcacctgcgcccccgtatcgggcgcatgatgtaagagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaatggggtgacagtgacagaggattatgatggtagtcaggatgagctgaagtatgaatgggtggaatttgagctgcccgaaggcaacttctcggtgaccatgaccatcgacctgatgaacaacgccatcatcgacaattacttggcggtggggcggcagaacggggtgctggagagcgacatcggcgtgaagttcgacactaggaacttcaggctgggctgggaccccgtgaccgagctggtcatgcccggggtgtacaccaacgaggctttccatcccgatattgtcttgctgcccggctgcggggtggacttcaccgagagccgcctcagcaacctgctgggcattcgcaagaggcagcccttccaggaaggcttccagatcatgtacgaggatctggaggggggcaacatccccgcgctcctggatgtcgacgcctatgagaaaagcaaggaggatgcagcagctgaagcaactgcagccgtagctaccgcctctaccgaggtcaggggcgataattttgcaagcgccgcagcagtggcagcggccgaggcggctgaaaccgaaagtaagatagtcattcagccggtggagaaggatagcaagaacaggagctacaacgtactaccggacaagataaacaccgcctaccgcagctggtacctagcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccctgcggtggtgaaggaggaaagaaagccccgcaaaatcaagcgggtcaaaaaggacaaaaaggaagaagaaagtgatgtggacggattggtggagtttgtgcgcgagttcgccccccggcggcgcgtgcagtggcgcgggcggaaggtgcaaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgttccgcaccgaaggaagaggcggtgtccatcccgctggaccacggcaaccccacgccgagcctcaagcccgtgaccttgcagcaggtgctgccgaccgcggcgccgcgccgggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagattcccacggagcccatggaaacgcagaccgagcccatgatcaagcccagcaccagcaccatggaggtgcagacggatccctggatgccatcggctcctagtcgaagaccccggcgcaagtacggcgcggccagcctgctgatgcccaactacgcgctgcatccttccatcatccccacgccgggctaccgcggcacgcgcttctaccgcggtcataccagcagccgccgccgcaagaccaccactcgccgccgccgtcgccgcaccgccgctgcaaccacccctgccgccctggtgcggagagtgtaccgccgcggccgcgcacctctgaccctgccgcgcgcgcgctaccacccgagcatcgccatttaaactttcgcctgctttgcagatcaatggccctcacatgccgccttcgcgttcccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggataagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgatgcggaggagacgctgctgacgcacacggacgagccgcccccgtacgaggaggcggtgaaactgggtctgcccaccacgcggcccatcgcgcccctggccaccggggtgctgaaacccgaaaagcccgcgaccctggacttgcctcctccccagccttcccgcccctctacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagtttgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccctagcttcaaaccctactccggcaccgcctacaacagtctggcccccaagggagcacccaacacttgtcagtggacatataaagccgatggtgaaactgccacagaaaaaacctatacatatggaaatgcacccgtgcagggcattaacatcacaaaagatggtattcaacttggaactgacaccgatgatcagccaatctacgcagataaaacctatcagcctgaacctcaagtgggtgatgctgaatggcatgacatcactggtactgatgaaaagtatggaggcagagctcttaagcctgataccaaaatgaagccttgttatggttcttttgccaagcctactaataaagaaggaggtcaggcaaatgtgaaaacaggaacaggcactactaaagaatatgacatagacatggctttctttgacaacagaagtgcggctgctgctggcctagctccagaaattgttttgtatactgaaaatgtggatttggaaactccagatacccatattgtatacaaagcaggcacagatgacagcagctcttctattaatttgggtcagcaagccatgcccaacagacctaactacattggtttcagagacaactttatcgggctcatgtactacaacagcactggcaatatgggggtgctggccggtcaggcttctcagctgaatgctgtggttgacttgcaagacagaaacaccgagctgtcctaccagctcttgcttgactctctgggtgacagaacccggtatttcagtatgtggaatcaggcggtggacagctatgatcctgatgtgcgcattattgaaaatcatggtgtggaggatgaacttcccaactattgtttccctctggatgctgttggcagaacagatacttatcagggaattaaggctaatggaactgatcaaaccacatggaccaaagatgacagtgtcaatgatgctaatgagataggcaagggtaatccattcgccatggaaatcaacatccaagccaacctgtggaggaacttcctctacgccaacgtggccctgtacctgcccgactcttacaagtacacgccggccaatgttaccctgcccaccaacaccaacacctacgattacatgaacggccgggtggtggcgccctcgctggtggactcctacatcaacatcggggcgcgctggtcgctggatcccatggacaacgtgaaccccttcaaccaccaccgcaatgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagccatggccgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaatcaagacatgtaaaccgtgtgtgtatgttaaatgtctttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttgggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgccttcccatggtgggcacgcacccgggcttgtggttgcaatcgcagtgcagggggatcagcatcatctgggcctggtcggcgttcatccccgggtacatggccttcatgaaagcctccaattgcctgaacgcctgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggtcccgtgcaggcaccgcagcttgccctcggcctcggtgcacccgtgcagccacagcgcgcacccggtgcactcccagttcttgtgggcgatctgggaatgcgcgtgcacgaagccctgcaggaagcggcccatcatggtggtcagggtcttgttgctagtgaaggtcagcggaatgccgcggtgctcctcgttgatgtacaggtggcagatgcggcggtacacctcgccctgctcgggcatcagctggaagttggctttcaggtcggtctccacgcggtagcggtccatcagcatagtcatgatttccatacccttctcccaggccgagacgatgggcaggctcatagggttcttcaccatcatcttagcgctagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacgtcctgcaggaccacatgcttggtcttgcggggtttcttcttgggcggcagcggcggcggagatgttggagatggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccgccgacgagaagcagcagcagcagaatgaaagcttaaccgccccgccgcccagccccgccacctccgacgcggccgtcccagacatgcaagagatggaggaatccatcgagattgacctgggctatgtgacgcccgcggagcacgaggaggagctggcagtgcgcttttcacaagaagagatacaccaagaacagccagagcaggaagcagagaatgagcagagtcaggctgggctcgagcatgacggcgactacctccacctgagcgggggggaggacgcgctcatcaagcatctggcccggcaggccaccatcgtcaaggatgcgctgctcgaccgcaccgaggtgcccctcagcgtggaggagctcagccgcgcctacgagttgaacctcttctcgccgcgcgtgccccccaagcgccagcccaatggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttcaacctgggtcccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctagtccccagagtttggaagagcggcgcaaactcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcattttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgaaggcgagggttcagccgccaaggggggtctgaaactcaccccggggctgtggacctcggcctacttgcgcaagttcgtgcccgaggactaccatcccttcgagatcaggttctacgaggaccaatcccatccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcgaccacacagtagatgggacgagaccggacgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaactttccccgcaacatcttgcattactaccgtcacctccacagcccctactacttccaagaagaggcagcagcagcagaaaaagaccagcagaaaaccagcagctagaaaatccacagcggcggcagcaggtggactgaggatcgcggcgaacgagccggcgcaaacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggtgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaaactaatcacccccttatccagtgaaataaagatcatattgatgatgattttacagaaataaaaaataatcatttgatttgaaataaagatacaatcatattgatgatttgagtttaacaaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgattcctcgggaaaactcatctccaacacggccaccaaggccgccgcccctctcagtttttccaacaacaccatttcccttaacatggatcaccccttttacactaaagatggaaaattatccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaatggagatgtttcaaaacctatgcttctcactataaccctcaatggtactgatgacagcaacagtacatattcaatgtcattttcatacacctggactaatggaagctatgttggagcaacatttggggctaactcttataccttctcatacatcgcccaagaatgaacactgtatcccaccctgcatgccaacccttcccaccccactctgtggaacaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacagaaccaccaggttgttcaacagtccatagttcaacacgctccagccgaaactcatcgcgggaaggatgctacccacgtggccgtcgtaccagatcctcaggtaaatcaagtggtgccccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcaactcctcgggggtcaaaaccatatcccagggcacggggaactcttgcaggacagcgaaccccgcagaacagggcaatcctcgcacagaacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtctcggcgcttggaacgctcggtgttgaaattgtaaaacagccactctctcagaccgtgcagcagatctagggcctcaggagtgatgaagatcccatcatgcctgatggctctgatcacatcgaccaccgtggaatgggccagacccagccagatgatgcaattttgttgggtttcggtgacggcgagcctcgggaacaacgatgaagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcgcccgaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaaactgccgtcatttccgggttcccacgctacgtcatcaaaacacgactttcaaattccgtcgaccgttaaaaacgtcacccgccccgcccctaacggtcgcccgtctctcagccaatcagcgccccgcatccccaaattcaaacacctcatttgcatattaacgcgcacaaaaagtttgaggtatattattgatgatg

SEQ ID NO: 72 - protein, 8 aa, Mus sp.
SIINFEKL

SEQ ID NO: 73 - protein, 9 aa, Mus sp.
SPSYAYHQF

SEQ ID NO: 74 - protein, 100 aa, synthetic construct
  REGION 1..100: note = Description of Artificial Sequence: Synthetic polypeptide
VTNTEMFVTAPDNLGYMYEVQWPGQTQPQIANCSVYDFFVWLHYYSVRDTVTNTEMFVTAPDNLGYMYEVQWPGQTQPQIANCSVYDFFVWLHYYSVRDT

SEQ ID NO: 75 - protein, 25 aa, Mus sp.
VTNTEMFVTAPDNLGYMYEVQWPGQ

SEQ ID NO: 76 - protein, 25 aa, Mus sp.
TQPQIANCSVYDFFVWLHYYSVRDT

SEQ ID NO: 77 - protein, 10 aa, Homo sapiens
YVYVADVAAK

SEQ ID NO: 78 - protein, 9 aa, Homo sapiens
NLVPMVATV

SEQ ID NO: 79 - protein, 9 aa, Homo sapiens
CLGGLLTMV

SEQ ID NO: 80 - protein, 9 aa, Homo sapiens
GILGFVFTL

SEQ ID NO: 81 - protein, 9 aa, Homo sapiens
LLFGYPVYV

SEQ ID NO: 82 - protein, 9 aa, Homo sapiens
GLCTLVAML

SEQ ID NO: 83 - protein, 9 aa, unidentified
  REGION 1..9: note = Description of Unknown: T2 epitope sequence
WLSLLVPFV

SEQ ID NO: 84 - protein, 8 aa, unidentified
  REGION 1..8: note = Description of Unknown: T2 epitope sequence
FLLTRICT

SEQ ID NO: 85 - protein, 8 aa, Homo sapiens
WQAGILAR

SEQ ID NO: 86 - protein, 8 aa, Homo sapiens
QGQNLKYQ

SEQ ID NO: 87 - protein, 25 aa, Homo sapiens
WQAGILARNLVPMVATVQGQNLKYQ

SEQ ID NO: 88 - protein, 9 aa, Homo sapiens
NTDNNLAVY

SEQ ID NO: 89 - protein, 9 aa, Homo sapiens
EVDPIGHVY

SEQ ID NO: 90 - protein, 9 aa, Homo sapiens
LLASSILCA

SEQ ID NO: 91 - protein, 10 aa, Homo sapiens
AIFPGAVPAA

SEQ ID NO: 92 - protein, 9 aa, Homo sapiens
VYDLSRDIL

SEQ ID NO: 93 - protein, 10 aa, Homo sapiens
ASSLPTTMNY

SEQ ID NO: 94 - protein, 13 aa, Homo sapiens
PKYVKQNTLKLAT

SEQ ID NO: 95 - protein, 14 aa, Homo sapiens
LPLKMLNIPSINVH

SEQ ID NO: 96 - protein, 15 aa, Homo sapiens
PEQWMFQGAPPSQGT

SEQ ID NO: 97 - protein, 15 aa, Homo sapiens
EHPTFTSQYRIQGKL

SEQ ID NO: 98 - protein, 25 aa, Homo sapiens
PILSPLTKGILGFVFTLTVPSERGL

SEQ ID NO: 99 - protein, 25 aa, Homo sapiens
HFPGFGQSLLFGYPVYVFGDCVQGD

SEQ ID NO: 100 - protein, 25 aa, Homo sapiens
RMQAIQNAGLCTLVAMLEETIFWLQ

SEQ ID NO: 101 - protein, 25 aa, Homo sapiens
RTYGPVFMCLGGLLTMVAGAVWLTV

SEQ ID NO: 102 - protein, 25 aa, Homo sapiens
SSSGLINSNTDNNLAVYDLSRDILN

SEQ ID NO: 103 - protein, 25 aa, Homo sapiens
LVFGIELMEVDPIGHVYIFATCLGL

SEQ ID NO: 104 - protein, 25 aa, Homo sapiens
MNFYLLLASSILCALIVFWKYRRFQ

SEQ ID NO: 105 - protein, 25 aa, Homo sapiens
AAAAAAAAIFPGAVPAARPPYPGAV

SEQ ID NO: 106 - protein, 25 aa, Homo sapiens
SNTDNNLAVYDLSRDILNNFPHSIA

SEQ ID NO: 107 - protein, 25 aa, Homo sapiens
DPPQSPQGASSLPTTMNYPLWSQSY

SEQ ID NO: 108 - protein, 25 aa, Homo sapiens
ITYGACPKYVKQNTLKLATGMRNVP

SEQ ID NO: 109 - protein, 25 aa, Homo sapiens
SIYVYALPLKMLNIPSINVHHYPSA

SEQ ID NO: 110 - protein, 25 aa, Homo sapiens
EGPWVPEQWMFQGAPPSQGTDVVQH

SEQ ID NO: 111 - protein, 25 aa, Homo sapiens
RGPQYSEHPTFTSQYRIQGKLEYRH

SEQ ID NO: 112 - protein, 9 aa, Macaca mulatta
CTPYDINQM

SEQ ID NO: 113 - protein, 8 aa, Macaca mulatta
TTPESANL

SEQ ID NO: 114 - protein, 9 aa, Macaca mulatta
CAPPGYALL

SEQ ID NO: 115 - protein, 9 aa, Macaca mulatta
SGPKTNIIV

SEQ ID NO: 116 - protein, 9 aa, Macaca mulatta
LSPRTLNAW

SEQ ID NO: 117 - protein, 9 aa, Macaca mulatta
TVPWPNASL

SEQ ID NO: 118 - protein, 15 aa, Macaca mulatta
PNGTHSWEYWGAQLN

SEQ ID NO: 119 - protein, 13 aa, Macaca mulatta
YKYKVVKIEPLGV

SEQ ID NO: 120 - protein, 15 aa, Macaca mulatta
TEEAKQIVQRHLVVE

SEQ ID NO: 121 - protein, 13 aa, Macaca fascicularis
AGSLQGQWRGAAG

SEQ ID NO: 122 - protein, 16 aa, Macaca fascicularis
EISTNIRQAGVQYSRA

SEQ ID NO: 123 - protein, 9 aa, Macaca fascicularis
RPKQAWCWF

SEQ ID NO: 124 - protein, 9 aa, Macaca fascicularis
RPKVPLRTM

SEQ ID NO: 125 - protein, 9 aa, Macaca fascicularis
GPRKPIKCW

SEQ ID NO: 126 - protein, 9 aa, Macaca fascicularis
LNMADKKET

SEQ ID NO: 127 - protein, 25 aa, Macaca mulatta
MFQALSEGCTPYDINQMLNVLGDHQ

SEQ ID NO: 128 - protein, 25 aa, Macaca mulatta
SCISEADATTPESANLGEEILSQLY

SEQ ID NO: 129 - protein, 25 aa, Macaca mulatta
WDAIRFRYCAPPGYALLRCNDTNYS

SEQ ID NO: 130 - protein, 25 aa, Macaca mulatta
AFLMALTDSGPKTNIIVDSQYVMGI

SEQ ID NO: 131 - protein, 25 aa, Macaca mulatta
GNVWVHTPLSPRTLNAWVKAVEEKK

SEQ ID NO: 132 - protein, 25 aa, Macaca mulatta
AFRQVCHTTVPWPNASLTPKWNNET

SEQ ID NO: 133 - protein, 25 aa, Macaca mulatta
VFNFPPNGTHSWEYWGAQLNAMKGD

SEQ ID NO: 134 - protein, 25 aa, Macaca mulatta
NWRSELYKYKVVKIEPLGVAPTKAK

SEQ ID NO: 135 - protein, 25 aa, Macaca mulatta
EKVKHTEEAKQIVQRHLVVETGTTE

SEQ ID NO: 136 - protein, 25 aa, Macaca fascicularis
DQVESTAGSLQGQWRGAAGTAAQAA

SEQ ID NO: 137 - protein, 25 aa, Macaca fascicularis
QELDEISTNIRQAGVQYSRADEEQQ

SEQ ID NO: 138 - protein, 25 aa, Macaca fascicularis
FHSQPINERPKQAWCWFGGSWKEAI

SEQ ID NO: 139 - protein, 25 aa, Macaca fascicularis
DDIDEEDDDLVGVSVRPKVPLRTMS

SEQ ID NO: 140 - protein, 25 aa, Macaca fascicularis
PFAAAQQRGPRKPIKCWNCGKEGHS

SEQ ID NO: 141 - protein, 25 aa, Macaca fascicularis
RRLTARGLLNMADKKETRTPKKAKA

SEQ ID NO: 142 - protein, 9 aa, Mus sp.
EGPRNQDWL

SEQ ID NO: 143 - protein, 9 aa, Mus sp.
TAPDNLGYM

SEQ ID NO: 144 - protein, 9 aa, Mus sp.
SVYDFFVWL

SEQ ID NO: 145 - protein, 9 aa, Mus sp.
MNKYAYHML

SEQ ID NO: 146 - protein, 8 aa, Mus sp.
SIIVFNLL

SEQ ID NO: 147 - protein, 9 aa, Mus sp.
ASMTNMELM

SEQ ID NO: 148 - protein, 9 aa, Mus sp.
AQLANDVVL

SEQ ID NO: 149 - protein, 9 aa, Mus sp.
LPYLGWLVF

SEQ ID NO: 150 - protein, 10 aa, Mus sp.
GYCGLRGTGV

SEQ ID NO: 151 - protein, 8 aa, Mus sp.
LSIFKHKL

SEQ ID NO: 152 - protein, 8 aa, Mus sp.
LIWIPALL

SEQ ID NO: 153 - protein, 9 aa, Mus sp.
SSGHNECPV

SEQ ID NO: 154 - protein, 9 aa, Mus sp.
GQKMNAQAI

SEQ ID NO: 155 - protein, 17 aa, Mus sp.
ISQAVHAAHAEINEAGR

SEQ ID NO: 156 - protein, 20 aa, Mus sp.
MTEQQWNFAGIEAAASAIQG

SEQ ID NO: 157 - protein, 21 aa, Mus sp.
FNNFTVSFWLRVPKVSASHLE

SEQ ID NO: 158 - protein, 15 aa, Mus sp.
DGSTDYGILQINSRW

SEQ ID NO: 159 - protein, 21 aa, Mus sp.
MEVGWYRSPFSRVVHLYRNGK

SEQ ID NO: 160 - protein, 25 aa, Mus sp.
VSGLEQLESIINFEKLTEWTSSNVM

SEQ ID NO: 161 - protein, 25 aa, Mus sp.
ALLAVGALEGPRNQDWLGVPRQLVT

SEQ ID NO: 162 - protein, 25 aa, Mus sp.
LWPRVTYHSPSYAYHQFERRAKYKR

SEQ ID NO: 163 - protein, 25 aa, Mus sp.
LWPRVTYHMNKYAYHMLERRAKYKR

SEQ ID NO: 164 - protein, 25 aa, Mus sp.
GQSLVISASIIVFNLLELEGDYRDD

SEQ ID NO: 165 - protein, 25 aa, Mus sp.
GIPVHLELASMTNMELMSSIVHQQV

SEQ ID NO: 166 - protein, 25 aa, Mus sp.
RVLELFRAAQLANDVVLQIMELCGA

SEQ ID NO: 167 - protein, 25 aa, Mus sp.
HRYSLEEILPYLGWLVFAVVTTSFL

SEQ ID NO: 168 - protein, 25 aa, Mus sp.
YLSKNPDGYCGLRGTGVSCPMAIKK

SEQ ID NO: 169 - protein, 25 aa, Mus sp.
NEIPFTYEQLSIFKHKLDKTYPQGY

SEQ ID NO: 170 - protein, 25 aa, Mus sp.
SRASLLGPGFVLIWIPALLPALRLS

SEQ ID NO: 171 - protein, 25 aa, Mus sp.
NWHKGWNWSSGHNECPVGASCHPFT

SEQ ID NO: 172 - protein, 25 aa, Mus sp.
KTLLKVSKGQKMNAQAIALVACYLR

SEQ ID NO: 173 - protein, 25 aa, Mus sp.
ESLKISQAVHAAHAEINEAGREVVG

SEQ ID NO: 174 - protein, 25 aa, Mus sp.
MTEQQWNFAGIEAAASAIQGNVTSI

SEQ ID NO: 175 - protein, 25 aa, Mus sp.
DMFNNFTVSFWLRVPKVSASHLEQY

SEQ ID NO: 176 - protein, 25 aa, Mus sp.
TNRNTDGSTDYGILQINSRWWCNDG

SEQ ID NO: 177 - protein, 25 aa, Mus sp.
TGMEVGWYRSPFSRVVHLYRNGKDQ

SEQ ID NO: 178 - DNA, 20 bp, synthetic construct
  misc_feature 1..20: note = Description of Artificial Sequence: Synthetic primer
  source 1..20: mol_type = other DNA
gtggtgtgcagcgagaatag

SEQ ID NO: 179 - DNA, 22 bp, synthetic construct
  misc_feature 1..22: note = Description of Artificial Sequence: Synthetic primer
  source 1..22: mol_type = other DNA
cgctcgttgtagatgtcgttag

SEQ ID NO: 180 - DNA, 15 bp, synthetic construct
  misc_feature 1..15: note = Description of Artificial Sequence: Synthetic probe
  source 1..15: mol_type = other DNA
ttcatgcccgtgttg

SEQ ID NO: 181 - DNA, 22 bp, synthetic construct
  misc_feature 1..22: note = Description of Artificial Sequence: Synthetic primer
  source 1..22: mol_type = other DNA
gtttttgatccagacccagatg

SEQ ID NO: 182 - DNA, 21 bp, synthetic construct
  misc_feature 1..21: note = Description of Artificial Sequence: Synthetic primer
  source 1..21: mol_type = other DNA
gcccattattcagagcgagta

SEQ ID NO: 183 - DNA, 14 bp, synthetic construct
  misc_feature 1..14: note = Description of Artificial Sequence: Synthetic probe
  source 1..14: mol_type = other DNA
tcaccaggatccac

SEQ ID NO: 184 - DNA, 17 bp, synthetic construct
  misc_feature 1..17: note = Description of Artificial Sequence: Synthetic primer
  source 1..17: mol_type = other DNA
ccttgcacatgccggag

SEQ ID NO: 185 - DNA, 17 bp, synthetic construct
  misc_feature 1..17: note = Description of Artificial Sequence: Synthetic primer
  source 1..17: mol_type = other DNA
acagagcctcgcctttg

SEQ ID NO: 186 - DNA, 12 bp, synthetic construct
  misc_feature 1..12: note = Description of Artificial Sequence: Synthetic probe
  source 1..12: mol_type = other DNA
gtgagctggcgg

SEQ ID NO: 187 - DNA, 22 bp, synthetic construct
  misc_feature 1..22: note = Description of Artificial Sequence: Synthetic primer
  source 1..22: mol_type = other DNA
ctgaaagctcggtttgctaatg

SEQ ID NO: 188 - DNA, 21 bp, synthetic construct
  misc_feature 1..21: note = Description of Artificial Sequence: Synthetic primer
  source 1..21: mol_type = other DNA
ccatgctggaagagacaatct

SEQ ID NO: 189 - DNA, 15 bp, synthetic construct
  misc_feature 1..15: note = Description of Artificial Sequence: Synthetic probe
  source 1..15: mol_type = other DNA
tggcgctgaccgata

SEQ ID NO: 190 - DNA, 22 bp, synthetic construct
  misc_feature 1..22: note = Description of Artificial Sequence: Synthetic primer
  source 1..22: mol_type = other DNA
tatgcctatcctgtctcctctg

SEQ ID NO: 191 - DNA, 22 bp, synthetic construct
  misc_feature 1..22: note = Description of Artificial Sequence: Synthetic primer
  source 1..22: mol_type = other DNA
gctaatgcagctaagtcctctc

SEQ ID NO: 192 - DNA, 15 bp, synthetic construct
  misc_feature 1..15: note = Description of Artificial Sequence: Synthetic probe
  source 1..15: mol_type = other DNA
tgaccgtgccttctg

SEQ ID NO: 193 - protein, 9 aa, unidentified
  REGION 1..9: note = Description of Unknown: AH1 epitope sequence
SPSYVYHQF

SEQ ID NO: 194 - protein, 14 aa, synthetic construct
  REGION 1..14: note = Description of Artificial Sequence: Synthetic peptide
QYIKANSKFIGITE

SEQ ID NO: 195 - protein, 9 aa, Homo sapiens
DLMGYIPAV

SEQ ID NO: 196 - protein, 10 aa, Homo sapiens
FLPSDFFPSV

SEQ ID NO: 197 - protein, 9 aa, Homo sapiens
FLLTRILTI

SEQ ID NO: 198 - protein, 9 aa, Homo sapiens
FLLSLGIHL

SEQ ID NO: 199 - protein, 9 aa, Homo sapiens
ILKEPVHGV

SEQ ID NO: 200 - protein, 10 aa, Homo sapiens
YMLDLQPETT

SEQ ID NO: 201 - protein, 9 aa, Homo sapiens
CINGVCWTV

SEQ ID NO: 202 - protein, 10 aa, Homo sapiens
YLLPRRGPRL

SEQ ID NO: 203 - protein, 9 aa, Homo sapiens
FLYALALLL

SEQ ID NO: 204 - protein, 9 aa, Homo sapiens
AAGIGILTV

SEQ ID NO: 205 - protein, 9 aa, Homo sapiens
SLLMWITQV

SEQ ID NO: 206 - protein, 9 aa, Homo sapiens
KLGGALQAK

SEQ ID NO: 207 - protein, 9 aa, Homo sapiens
RLRAEAQVK

SEQ ID NO: 208 - protein, 10 aa, Homo sapiens
EENLLDFVRF

SEQ ID NO: 209 - protein, 9 aa, Homo sapiens
EEYLQAFTY

SEQ ID NO: 210 - protein, 9 aa, Mus sp.
DWENVSPEL

What is claimed is:

1. An isolated cell comprising an adenovirus vector, wherein the adenovirus vector comprises:
an adenoviral backbone comprising one or more genes or regulatory sequences of an adenovirus genome, wherein the adenoviral backbone comprises a partially deleted E4 gene with reference to the adenovirus genome, wherein the partially deleted E4 gene comprises a partially-deleted E4orf2 region, a deleted E4orf3 region, and a partially-deleted E4orf4 region, and wherein the adenovirus vector further comprises a cassette, the cassette comprising:
  (1) at least one payload nucleic acid sequence, optionally wherein the at least one payload nucleic acid sequence encodes a polypeptide, optionally wherein the polypeptide comprises an antigen, optionally wherein the antigen comprises:
    (a) a MHC class I epitope,
    (b) a MHC class II epitope,
    (c) an epitope capable of stimulating a B cell response, or
    (d) a combination thereof, and
  optionally wherein the at least one payload nucleic acid sequence further comprises a 5' linker sequence and/or a 3' linker sequence, and optionally wherein;
  (2) at least one promoter sequence operably linked to the at least one payload nucleic acid sequence,
  (3) optionally, at least one universal MHC class II antigen-encoding nucleic acid sequence;
  (4) optionally, at least one GPGPG-encoding linker sequence (SEQ ID NO:56); and
  (5) optionally, at least one polyadenylation sequence.

2. The cell of claim 1, wherein the isolated cell is selected from the group consisting of: a CHO cell, a HEK293 cell or variants thereof, a 911 cell, a HeLa cell, a A549 cell, a PER.C6 cell, and a AE1-2a cell.

3. The cell of claim 1, wherein the isolated cell is a HEK293 cell or variants thereof.

4. The cell of claim 1, wherein:
  (a) the partially deleted E4 gene comprises the E4 gene sequence shown in SEQ ID NO: 1 except for lacking the partially-deleted E4orf2 region, the deleted E4orf3 region, and the partially-deleted E4orf4 region; and
  (b) the one or more genes or regulatory sequences of the adenovirus genome comprise one or more genes or regulatory sequences of the ChAdV68 sequence shown in SEQ ID NO:1, optionally wherein the one or more genes or regulatory sequences comprise at least one of the chimpanzee adenovirus inverted terminal repeat (ITR), E1A, E1B, E2A, E2B, E3, L1, L2, L3, L4, and L5 genes of the sequence shown in SEQ ID NO:1.

5. The cell of claim 4, wherein the one or more genes or regulatory sequences of the ChAdV68 sequence shown in SEQ ID NO:1 comprise:
  A) nucleotides 2 to 34,915 of the sequence shown in SEQ ID NO:1, or
  B) nucleotides 2 to 34,915 of the sequence shown in SEQ ID NO:1 except for lacking:
    (i) nucleotides corresponding to a deletion in the E1 gene shown in SEQ ID NO:1; and/or
    (ii) nucleotides corresponding to a deletion in the E3 gene shown in SEQ ID NO:1.

6. The cell of claim 4, wherein the partially-deleted E4orf2 region, the deleted E4orf3 region, and the partially-deleted E4orf4 region is a deletion of nucleotides about in the range of 34,916 to 35,642 of the sequence shown in SEQ ID NO:1.

7. The cell of claim 4, wherein the partially-deleted E4orf2 region, the deleted E4orf3 region, and the partially-deleted E4orf4 region is a deletion of nucleotides 34,916 to 35,642 of the sequence shown in SEQ ID NO:1.

8. The cell of claim 4, wherein the adenoviral backbone comprises:
  A) at least nucleotides 2 to 36,518 of the sequence shown in SEQ ID NO:1, except for lacking nucleotides 34,916 to 35,642 of the sequence shown in SEQ ID NO: 1 corresponding to the partially deleted E4 gene,
  B) at least nucleotides 2 to 36,518 of the sequence shown in SEQ ID NO:1, except for lacking nucleotides 34,916 to 35,642 corresponding to the partially deleted E4 gene and lacking nucleotides 577 to 3403 of the sequence shown in SEQ ID NO:1,
  C) at least nucleotides 2 to 36,518 of the sequence shown in SEQ ID NO:1, except for lacking nucleotides 34,916 to 35,642 corresponding to the partially deleted E4 gene and lacking nucleotides 27,125 to 31,825 of the sequence shown in SEQ ID NO:1, or
  D) at least nucleotides 2 to 36,518 of the sequence shown in SEQ ID NO:1, except for lacking nucleotides 34,916 to 35,642 corresponding to the partially deleted E4 gene, lacking nucleotides 577 to 3403, and lacking nucleotides 27,125 to 31,825 of the sequence shown in SEQ ID NO:1.

9. The cell of claim 1, wherein the cassette is inserted in the vector at the E1 region, E3 region, and/or any deleted AdV region that allows incorporation of the cassette.

10. The cell of claim 1, wherein at least one of the at least one payload nucleic acid sequences encodes a polypeptide sequence capable of undergoing antigen processing into an epitope, wherein the epitope is known or suspected to be presented by MHC class I on a surface of a cell, and wherein the surface of the cell is a tumor cell surface.

11. The cell of claim 1, wherein at least one of the at least one payload nucleic acid sequences encodes an epitope with at least one alteration that makes the encoded epitope sequence distinct from the corresponding peptide sequence encoded by a wild-type nucleic acid sequence, optionally wherein the at least one alteration comprises a point mutation, a frameshift mutation, a non-frameshift mutation, a deletion mutation, an insertion mutation, a splice variant, a genomic rearrangement, or a proteasome-generated spliced antigen.

12. The cell of claim 1, wherein one or more of the at least one payload nucleic acid sequences encode an MHC I epitope-encoding nucleic acid sequence inclusive of the optional 5' linker sequence and the optional 3' linker sequences that encodes a peptide 25 amino acids in length.

13. The cell of claim 1, wherein at least one of the at least one payload nucleic acid sequences is linked to a distinct payload nucleic acid sequence with a nucleic acid sequence encoding a linker.

14. The cell of claim 13, wherein the linker comprises one or more native sequences flanking the antigen derived from the cognate protein of origin and that is at least 2, 3, 4, 5, 6, 7, 8, 9, 10, 11, 12, 13, 14, 15, 16, 17, 18, 19, 20, or 2-20 amino acid residues in length.

15. The cell of claim 1, wherein the adenovirus vector comprises:
  A) a modified ChAdV68 sequence, wherein the modified ChAdV68 sequence comprises:
    (i) the partially deleted E4 gene comprising the E4 gene sequence shown in SEQ ID NO: 1 except for lacking nucleotides 34,916 to 35,642 of the sequence shown in SEQ ID NO:1;
    (ii) (1) nucleotides 2 to 34,915 of the sequence shown in SEQ ID NO:1 or
    (ii) (2) nucleotides 2 to 34,915 of the sequence shown in SEQ ID NO:1 except for lacking, a) nucleotides 577 to 3403 of the sequence shown in SEQ ID NO:1 corresponding to an E1 deletion; and/or
b) nucleotides 27,125 to 31,825 of the sequence shown in SEQ ID NO:1 corresponding to an E3 deletion wherein the partially deleted E4 gene is 3' of the nucleotide 34,915 of the sequence shown in SEQ ID NO:1; and (iii) nucleotides 35,643 to 36,518 of the sequence shown in SEQ ID NO:1, wherein the partially deleted E4 gene is 5' of the nucleotide 35,643 of the sequence shown in SEQ ID NO:1;

B) a CMV-derived promoter sequence;
C) an SV40 polyadenylation signal nucleotide sequence; and
D) a cassette, the cassette comprising at least one at least one payload nucleic acid sequence encoding:
 (i) at least one MHC class I epitope, optionally wherein the at least one MHC class I epitope comprises at least 2 distinct MHC class I epitopes linearly linked to each other and each optionally comprising:
  (A) at least one alteration that makes the encoded peptide sequence distinct from the corresponding peptide sequence encoded by a wild-type nucleic acid sequence, wherein the distinct MHC I epitope is 7-15 amino acids in length,
  (B) a native 5' linker sequence that encodes a native N-terminal amino acid sequence of the epitope, and wherein the 5' linker sequence encodes a peptide that is between 2-20 amino acids in length,
  (C) a native 3' linker sequence that encodes a native C-terminal amino acid sequence of the epitope, and wherein the 3' linker sequence encodes a peptide that is between 2-20 amino acids in length, or
  (D) combinations thereof,
 (ii) at least one MHC class II epitope, optionally wherein the at least one MHC class II epitope comprises at least 2 distinct MHC class II epitopes,
 (iii) at least one an epitope capable of stimulating a B cell response, or
 (iv) combinations thereof, and
wherein the cassette is inserted within a deleted region of ChAdV68 and the CMV-derived promoter sequence is operably linked to the cassette.

16. The cell of claim 1, wherein the at least one promoter sequence is a regulatable promoter comprising a tetracycline (TET) repressor protein (TETr) controlled promoter, and wherein the isolated cell is engineered to express the TETr protein.

17. The cell of claim 1, wherein at least one of the at least one payload nucleic acid sequences encodes:
 (a) a peptide derived from a pathogen, wherein the pathogen is selected from the group consisting of: a virus, a bacteria, a fungi, a protozoan, and a helminth;
 (b) an epitope with at least one alteration that makes the encoded epitope sequence distinct from the corresponding peptide sequence encoded by a wild-type nucleic acid sequence;
 (c) a polypeptide sequence or portion thereof comprising an epitope capable of stimulating a B cell response, wherein the polypeptide sequence or portion thereof comprises a full-length protein, a protein domain, a protein subunit, or an antigenic fragment predicted or known to be capable of being bound by an antibody; and/or
 (d) a non-coding nucleic acid sequence, optionally wherein the non-coding nucleic acid sequence comprises an RNA interference (RNAi) polynucleotide or genome-editing system polynucleotide.

18. A method of manufacturing an adenovirus vector, the method comprising:
 (A) one or both of (i) transfecting a plasmid sequence comprising the adenovirus vector into an isolated host cell, and (ii) infecting an isolated host cell with an adenovirus comprising the adenovirus vector,
  wherein the adenovirus vector comprises:
   an adenoviral backbone comprising one or more genes or regulatory sequences of an adenovirus genome,
   wherein the adenoviral backbone comprises a partially deleted E4 gene with reference to the adenovirus genome,
   wherein the partially deleted E4 gene comprises a partially-deleted E4orf2 region, a deleted E4orf3 region, and
   a partially-deleted E4orf4 region, and
   optionally, wherein the adenovirus vector further comprises a cassette, the cassette comprising:
    (1) at least one payload nucleic acid sequence, optionally wherein the at least one payload nucleic acid sequence encodes a polypeptide, optionally wherein the polypeptide comprises an antigen, optionally wherein the antigen comprises:
     (a) a MHC class I epitope,
     (b) a MHC class II epitope,
     (c) an epitope capable of stimulating a B cell response, or
     (d) a combination thereof, and
    optionally wherein the at least one payload nucleic acid sequence further comprises a 5' linker sequence and/or a 3' linker sequence, and optionally wherein;
    (2) at least one promoter sequence operably linked to the at least one payload nucleic acid sequence,
    (3) optionally, at least one universal MHC class II antigen-encoding nucleic acid sequence;
    (4) optionally, at least one GPGPG-encoding linker sequence (SEQ ID NO:56); and
    (5) optionally, at least one polyadenylation sequence; and
 (B) isolating the adenovirus vector from the host cell.

19. The method of manufacturing of claim 18, wherein the isolating comprises lysing the host cell to obtain a cell lysate comprising the adenovirus vector.

20. The method of manufacturing of claim 19, wherein the isolating further comprises purifying the adenovirus vector from the cell lysate.

21. The method of manufacturing of claim 20, wherein the purifying comprises one or more of chromatographic separation, centrifugation, virus precipitation, and filtration.

22. The method of manufacturing of claim 18, wherein the host cell is selected from the group consisting of: a CHO cell, a HEK293 cell or variants thereof, a 911 cell, a HeLa cell, a A549 cell, a LP 293 cell, a PER.C6 cell, and a AE1-2a cell.

23. The method of manufacturing of claim 18, wherein:
 (a) the partially deleted E4 gene comprises the E4 gene sequence shown in SEQ ID NO: 1 except for lacking the partially-deleted E4orf2 region, the deleted E4orf3 region, and the partially-deleted E4orf4 region; and
 (b) the one or more genes or regulatory sequences of the adenovirus genome comprise one or more genes or regulatory sequences of the ChAdV68 sequence shown in SEQ ID NO:1, optionally wherein the one or more genes or regulatory sequences comprise at least one of the chimpanzee adenovirus inverted terminal repeat (ITR), E1A, E1B, E2A, E2B, E3, L1, L2, L3, L4, and L5 genes of the sequence shown in SEQ ID NO:1.

24. The method of manufacturing of claim 18, wherein at least one of the at least one payload nucleic acid sequences encodes:
  (a) a peptide derived from a pathogen, wherein the pathogen is selected from the group consisting of: a virus, a bacteria, a fungi, a protozoan, and a helminth;
  (b) an epitope with at least one alteration that makes the encoded epitope sequence distinct from the corresponding peptide sequence encoded by a wild-type nucleic acid sequence;
  (c) a polypeptide sequence or portion thereof comprising an epitope capable of stimulating a B cell response, wherein the polypeptide sequence or portion thereof comprises a full-length protein, a protein domain, a protein subunit, or an antigenic fragment predicted or known to be capable of being bound by an antibody; and/or
  (d) a non-coding nucleic acid sequence, optionally wherein the non-coding nucleic acid sequence comprises an RNA interference (RNAi) polynucleotide or genome-editing system polynucleotide.

25. The method of manufacturing of claim 23, wherein the one or more genes or regulatory sequences of the ChAdV68 sequence shown in SEQ ID NO:1 comprise:
  A) nucleotides 2 to 34,915 of the sequence shown in SEQ ID NO:1, or
  B) nucleotides 2 to 34,915 of the sequence shown in SEQ ID NO: 1 except for lacking:
    (i) nucleotides corresponding to a deletion in the E1 gene shown in SEQ ID NO:1; and/or
    (ii) nucleotides corresponding to a deletion in the E3 gene shown in SEQ ID NO:1.

26. The method of manufacturing of claim 23, wherein the partially-deleted E4orf2 region, the deleted E4orf3 region, and the partially-deleted E4orf4 region is a deletion of nucleotides about in the range of 34,916 to 35,642 of the sequence shown in SEQ ID NO:1.

27. The method of manufacturing of claim 23, wherein the partially-deleted E4orf2 region, the deleted E4orf3 region, and the partially-deleted E4orf4 region is a deletion of nucleotides 34,916 to 35,642 of the sequence shown in SEQ ID NO:1.

28. The method of manufacturing of claim 23, wherein the adenoviral backbone comprises:
  A) at least nucleotides 2 to 36,518 of the sequence shown in SEQ ID NO:1, except for lacking nucleotides 34,916 to 35,642 of the sequence shown in SEQ ID NO:1 corresponding to the partially deleted E4 gene,
  B) at least nucleotides 2 to 36,518 of the sequence shown in SEQ ID NO:1, except for lacking nucleotides 34,916 to 35,642 corresponding to the partially deleted E4 gene and lacking nucleotides 577 to 3403 of the sequence shown in SEQ ID NO:1,
  C) at least nucleotides 2 to 36,518 of the sequence shown in SEQ ID NO:1, except for lacking nucleotides 34,916 to 35,642 corresponding to the partially deleted E4 gene and lacking nucleotides 27,125 to 31,825 of the sequence shown in SEQ ID NO:1, or
  D) at least nucleotides 2 to 36,518 of the sequence shown in SEQ ID NO:1, except for lacking nucleotides 34,916 to 35,642 corresponding to the partially deleted E4 gene, lacking nucleotides 577 to 3403, and lacking nucleotides 27,125 to 31,825 of the sequence shown in SEQ ID NO:1.

29. The method of manufacturing of claim 18, wherein the cassette is inserted in the vector at the E1 region, E3 region, and/or any deleted AdV region that allows incorporation of the cassette.

30. The method of manufacturing of claim 18, wherein at least one of the at least one payload nucleic acid sequences encodes a polypeptide sequence capable of undergoing antigen processing into an epitope, wherein the epitope is known or suspected to be presented by MHC class I on a surface of a cell, and wherein the surface of the cell is a tumor cell surface.

31. The method of manufacturing of claim 18, wherein one or more of the at least one payload nucleic acid sequences encode an MHC I epitope-encoding nucleic acid sequence inclusive of the optional 5' linker sequence and the optional 3' linker sequences that encodes a peptide 25 amino acids in length.

32. The method of manufacturing of claim 18, wherein at least one of the at least one payload nucleic acid sequences is linked to a distinct payload nucleic acid sequence with a nucleic acid sequence encoding a linker.

33. The method of manufacturing of claim 32, wherein the linker comprises one or more native sequences flanking the antigen derived from the cognate protein of origin and that is at least 2, 3, 4, 5, 6, 7, 8, 9, 10, 11, 12, 13, 14, 15, 16, 17, 18, 19, 20, or 2-20 amino acid residues in length.

34. The method of manufacturing of claim 18, wherein the adenovirus vector comprises:
  A) a modified ChAdV68 sequence, wherein the modified ChAdV68 sequence comprises:
    (i) the partially deleted E4 gene comprising the E4 gene sequence shown in SEQ ID NO:1 except for lacking nucleotides 34,916 to 35,642 of the sequence shown in SEQ ID NO:1;
    (ii) (1) nucleotides 2 to 34,915 of the sequence shown in SEQ ID NO:1 or
    (ii) (2) nucleotides 2 to 34,915 of the sequence shown in SEQ ID NO:1 except for lacking,
      a) nucleotides 577 to 3403 of the sequence shown in SEQ ID NO:1 corresponding to an E1 deletion; and/or
      b) nucleotides 27,125 to 31,825 of the sequence shown in SEQ ID NO:1 corresponding to an E3 deletion
    wherein the partially deleted E4 gene is 3' of the nucleotide 34,915 of the sequence shown in SEQ ID NO:1; and
    (iii) nucleotides 35,643 to 36,518 of the sequence shown in SEQ ID NO:1,
    wherein the partially deleted E4 gene is 5' of the nucleotide 35,643 of the sequence shown in SEQ ID NO:1;
  B) a CMV-derived promoter sequence;
  C) an SV40 polyadenylation signal nucleotide sequence; and
  D) a cassette, the cassette comprising at least one at least one payload nucleic acid sequence encoding:
    (i) at least one MHC class I epitope, optionally wherein the at least one MHC class I epitope comprises at least 2 distinct MHC class I epitopes linearly linked to each other and each optionally comprising:
      (A) at least one alteration that makes the encoded peptide sequence distinct from the corresponding peptide sequence encoded by a wild-type nucleic acid sequence, wherein the distinct MHC I epitope is 7-15 amino acids in length, (B) a native 5' linker sequence that encodes a native N-terminal amino acid sequence of the epitope, and wherein the 5' linker sequence encodes a peptide that is between 2-20 amino acids in length,
(C) a native 3' linker sequence that encodes a native C-terminal amino acid sequence of the epitope, and wherein the 3' linker sequence encodes a peptide that is between 2-20 amino acids in length, or
(D) combinations thereof,
(ii) at least one MHC class II epitope, optionally wherein the at least one MHC class II epitope comprises at least 2 distinct MHC class II epitopes,
(iii) at least one an epitope capable of stimulating a B cell response, or
(iv) combinations thereof, and
wherein the cassette is inserted within a deleted region of ChAdV68 and the CMV-derived promoter sequence is operably linked to the cassette.

35. The method of manufacturing of claim 18, wherein the at least one promoter sequence is a regulatable promoter comprising a tetracycline (TET) repressor protein (TETr) controlled promoter, and wherein the host cell is engineered to engineered to express the TETr protein.

* * * * *